US008460880B2

(12) United States Patent
Macina et al.

(10) Patent No.: US 8,460,880 B2
(45) Date of Patent: Jun. 11, 2013

(54) COMPOSITIONS, SPLICE VARIANTS AND METHODS RELATING TO OVARIAN SPECIFIC GENES AND PROTEINS

(75) Inventors: Roberto A. Macina, San Jose, CA (US); Leah R. Turner, Sunnyvale, CA (US); Yongming Sun, Redwood City, CA (US); Shu-Hui Liu, Redwood City, CA (US); Huei-Mei Chen, Pleasant Hill, CA (US)

(73) Assignee: diaDexus, Inc., South San Francisco, CA (US)

( * ) Notice: Subject to any disclaimer, the term of this patent is extended or adjusted under 35 U.S.C. 154(b) by 556 days.

(21) Appl. No.: 12/383,449

(22) Filed: Mar. 24, 2009

(65) Prior Publication Data
US 2009/0263411 A1     Oct. 22, 2009

Related U.S. Application Data

(63) Continuation of application No. 10/537,743, filed as application No. PCT/US03/38855 on Dec. 8, 2003, now abandoned.

(60) Provisional application No. 60/431,321, filed on Dec. 6, 2002, provisional application No. 60/431,301, filed on Dec. 6, 2002, provisional application No. 60/484,584, filed on Jun. 30, 2003, provisional application No. 60/518,607, filed on Nov. 7, 2003.

(51) Int. Cl.
*G01N 33/53* (2006.01)

(52) U.S. Cl.
USPC .......................................................... 435/7.1

(58) Field of Classification Search
None
See application file for complete search history.

(56) References Cited

U.S. PATENT DOCUMENTS 6,468,546 B1 * 10/2002 Mitcham et al. ............ 424/277.1
7,807,392 B1 * 10/2010 Domon et al. ............... 435/7.23

FOREIGN PATENT DOCUMENTS

| WO | 9953040 | 10/1999 |
|----|---------|---------|
| WO | WO-00-36107 A2 * | 6/2000 |
| WO | 0170979 | 9/2001 |
| WO | 0171015 | 9/2001 |
| WO | 0196389 | 12/2001 |
| WO | 0200677 | 1/2002 |
| WO | WO-02-00677 A1 * | 1/2002 |
| WO | 02058534 | 8/2002 |
| WO | 2004023973 | 3/2004 |

OTHER PUBLICATIONS

Neto et al., "Shotgun sequencing of the human transcriptome with ORF expressed sequence tags", Proc. Natl. Acad. Sci. USA 2000 97(7):3491-3496.
EMBL—EBI Database Accession No. BC008769—Jun. 8, 2001; XP-002380897.
Uniprot Database Accession No. Q96HB5—Dec. 1, 2001; XP-002380898.
Martoglio et al., "Changes in Tumorigenesis- and Angiogenesis-related Gene Transcript Abundance Profiles in Ovarian Cancer Detected by Tailored High Density cDNA Arrays", Molecular Medicine 2000 6(9):750-765.
Welsh et al., "Analysis of gene expression profiles in normal and neoplastic ovarian tissue samples identifies candidate molecular markers of epithelial ovarian cancer", Proc. Natl. Acad. Sci. USA 2001 98(3):1176-1181.

* cited by examiner

*Primary Examiner* — James Martinell
(74) *Attorney, Agent, or Firm* — Licata & Tyrrell P.C.; Keith R. McCollum

(57) ABSTRACT

The present invention relates to newly identified nucleic acid molecules and polypeptides present in normal and neoplastic ovarian cells, including fragments, variants and derivatives of the nucleic acids and polypeptides. The present invention also relates to antibodies to the polypeptides of the invention, as well as agonists and antagonists of the polypeptides of the invention. The invention also relates to compositions containing the nucleic acid molecules, polypeptides, antibodies, agonists and antagonists of the invention and methods for the use of these compositions. These uses include identifying, diagnosing, monitoring, staging, imaging and treating ovarian cancer and non-cancerous disease states in ovarian, identifying ovarian tissue, monitoring and identifying and/or designing agonists and antagonists of polypeptides of the invention. The uses also include gene therapy, production of transgenic animals and cells, and production of engineered ovarian tissue for treatment and research.

16 Claims, 43 Drawing Sheets

FIGURE 1

```
EpCAM_nt      1                                                                    0
Ovr232_nt     1   CAGATCTCAATTATCTAATTGCAATTGCAACGAGAACCAAAGCAGGGGAG              50

EpCAM_nt      1                                                                    0
Ovr232_nt    51   CAGAGACAAACAATTTCTGAGGTAACCAGATGGCTTTATTAACTCAAGTT             100

EpCAM_nt      1                                                                    0
Ovr232_nt   101   CTCACCTAAAATTGCCCTCAAGAATCCTGTGGGAATGGGTTGCAGTGGTG             150

EpCAM_nt      1                                                                    0
Ovr232_nt   151   TGGCCCTGGATTCACAACCGACAGAGCTTCTGAATTCTGAGTGATCTGTA             200

EpCAM_nt      1                                                                    0
Ovr232_nt   201   CACAAACACACCTCTGCCTGGGTTACACGCCTCCACGTTCCTCTATCCAG             250

EpCAM_nt      1                                                                    0
Ovr232_nt   251   TTCCCGCACCCTTCCCCCCAGGCCCCATTCTTCAAGGCTTCAGAGCAGCG             300

EpCAM_nt      1                                                                    0
Ovr232_nt   301   CTCCTCCGGTTAAAAGGAAGTCTCAGCACAGAATCTTCAAACCTCCTCGG             350

EpCAM_nt      1                                                                    0
Ovr232_nt   351   AGGCCACCAAAGATCCCTAACGCCGCCATGGAGACGAAGCACCTGGGGCG             400

EpCAM_nt      1                                                                    0
Ovr232_nt   401   GGGCGGAGCGGGGCGCGCGGGCCCACACCTGTGGAGAGGGCCGCGCCCCA             450

EpCAM_nt      1                                                                    0
Ovr232_nt   451   ACTGCAGCGCCGGGGCTGGGGGAGGGGAGCCTACTCACTCCCCCAACTCC             500

EpCAM_nt      1                                                                    0
Ovr232_nt   501   CGGGCGGTGACTCATCAACGAGCACCAGCGGCCAGAGGTGAGCAGTCCCG             550

EpCAM_nt      1                                                                    0
Ovr232_nt   551   GGAAGGGGCCGAGAGGCGGGGCCGCCAGGTCGGGCAGGTGTGCGCTCCGC             600

EpCAM_nt      1                                            CGGCGAGCGAGCACCTTCGAC    21
                                                           |||||||||||||||||||||
Ovr232_nt   601   CCCGCCGCGCGCACAGAGCGCTAGTCCTTCGGCGAGCGAGCACCTTCGAC             650

EpCAM_nt     22   GCGGTCCGGGGACCCCCTCGTCGCTGTCCTCCCGACGCGGACCCGCGTGC              71
                  ||||||||||||||||||||||||||||||||||||||||||||||||||
Ovr232_nt   651   GCGGTCCGGGGACCCCCTCGTCGCTGTCCTCCCGACGCGGACCCGCGTGC             700

EpCAM_nt     72   CCCAGGCCTCGCGCTGCCCGGCCGGCTCCTCGTGTCCCACTCCCGGCGCA             121
                  ||||||||||||||||||||||||||||||||||||||||||||||||||
Ovr232_nt   701   CCCAGGCCTCGCGCTGCCCGGCCGGCTCCTCGTGTCCCACTCCCGGCGCA             750
```

FIGURE 1 (continued)

```
EpCAM_nt    122 CGCCCTCCCGCGAGTCCCGGGCCCCTCCCGCGCCCCTCTTCTCGGCGCGC  171
                ||||||||||||||||||||||||||||||||||||||||||||||||||
Ovr232_nt   751 CGCCCTCCCGCGAGTCCCGGGCCCCTCCCGCGCCCCTCTTCTCGGCGCGC  800

EpCAM_nt    172 GCGCAGCATGGCGCCCCCGCAGGTCCTCGCGTTCGGGCTTCTGCTTGCCG  221
                ||||||||||||||||||||||||||||||||||||||||||||||||||
Ovr232_nt   801 GCGCAGCATGGCGCCCCCGCAGGTCCTCGCGTTCGGGCTTCTGCTTGCCG  850

EpCAM_nt    222 CGGCGACGGCGACTTTTGCCGCAGCTCAGGAAGAATGTGTCTGTGAAAAC  271
                ||||||||||||||||||||||||||||||||||||||||||||||||||
Ovr232_nt   851 CGGCGACGGCGACTTTTGCCGCAGCTCAGGAAGAATGTGTCTGTGAAAAC  900

EpCAM_nt    272 TACAAGCTGGCCGTAAACTGCTTTGTGAATAATAATCGTCAATGCCAGTG  321
                ||||||||||||||||||||||||||||||||||||||||||||||||||
Ovr232_nt   901 TACAAGCTGGCCGTAAACTGCTTTGTGAATAATAATCGTCAATGCCAGTG  950

EpCAM_nt    322 TACTTCAGTTGGTGCACAAAATACTGTCATTTGCTCAAAGC---------  362
                ||||||||||||||||||||||||||||||||||||||||
Ovr232_nt   951 TACTTCAGTTGGTGCACAAAATACTGTCATTTGCTCAAAGCGTGAGTAAA 1000

EpCAM_nt    363 --------------------------------------------------  362

Ovr232_nt  1001 ATATCCTAATTACCTGTAAGCTTTATTTTGACTTAATACTTCTTTAATTG 1050

EpCAM_nt    363 --------------------------------------------------  362

Ovr232_nt  1051 ATGTGCCTTGAGTTGGAAAGAGTTTTATTGGCTTAAATCTGAATCATGTT 1100

EpCAM_nt    363 --------------------------------------------------  362

Ovr232_nt  1101 ACAAAGTAAGTGTGGGAACACATAAATTTCAAATAATCTTTGACCCTGGA 1150

EpCAM_nt    363 --------------------------------------------------  362

Ovr232_nt  1151 ACTTTAGAGTTAATTTTTTTTTTCCCGTAATCATGAAATCAGTTATTTTT 1200

EpCAM_nt    363 ---------------------------TGGCTGCCAAATGTTTGGTGAT  384
                                           |||||||||||||||||||||||
Ovr232_nt  1201 CAGTTTGGCATTAAGGTTTCTTTTTCAGTGGCTGCCAAATGTTTGGTGAT 1250

EpCAM_nt    385 GAAGGCAGAAATGAATGGCTCAAAACTTGGGAGAAGAGCAAAACCTGAAG  434
                ||||||||||||||||||||||||||||||||||||||||||||||||||
Ovr232_nt  1251 GAAGGCAGAAATGAATGGCTCAAAACTTGGGAGAAGAGCAAAACCTGAAG 1300

EpCAM_nt    435 GGGCCCTCCAGAACAATGATGGGCTTTATGATCCTGACTGCGATGAGAGC  484
                ||||||||||||||||||||||||||||||||||||||||||||||||||
Ovr232_nt  1301 GGGCCCTCCAGAACAATGATGGGCTTTATGATCCTGACTGCGATGAGAGC 1350

EpCAM_nt    485 GGGCTCTTTAAGGCCAAGCAGTGCAACGGCACCTCCACGTGCTGGTGTGT  534
                |||||||||||||||||||||||||||||||||||||||.|||||||||
Ovr232_nt  1351 GGGCTCTTTAAGGCCAAGCAGTGCAACGGCACCTCCATGTGCTGGTGTGT 1400

EpCAM_nt    535 GAACACTGCTGGGGTCAGAAGAACAGACAAGGACACTGAAATAACCTGCT  584
                ||||||||||||||||||||||||||||||||||||||||||||||||||
Ovr232_nt  1401 GAACACTGCTGGGGTCAGAAGAACAGACAAGGACACTGAAATAACCTGCT 1450

EpCAM_nt    585 CTGAGCGAGTGAGAACCTACTGGATCATCATTGAACTAAAACACAAAGCA  634
                ||||||||||||||||||||||||||||||||||||||||||||||||||
Ovr232_nt  1451 CTGAGCGAGTGAGAACCTACTGGATCATCATTGAACTAAAACACAAAGCA 1500
```

FIGURE 1 (continued)

```
EpCAM_nt    635 AGAGAAAAACCTTATGATAGTAAAAGTTTGCGGACTGCACTTCAGAAGGA  684
                ||||||||||||||||||||||||||||||||||||||||||||||||||
Ovr232_nt  1501 AGAGAAAAACCTTATGATAGTAAAAGTTTGCGGACTGCACTTCAGAAGGA 1550

EpCAM_nt    685 GATCACAACGCGTTATCAACTGGATCCAAAATTTATCACGAGTATTTTGT  734
                ||||||||||||||||||||||||||||||||||||||||||||||||||
Ovr232_nt  1551 GATCACAACGCGTTATCAACTGGATCCAAAATTTATCACGAGTATTTTGT 1600

EpCAM_nt    735 ATGAGAATAATGTTATCACTATTGATCTGGTTCAAAATTCTTCTCAAAAA  784
                ||||||||||||||||||||||||||||||||||||||||||||||||||
Ovr232_nt  1601 ATGAGAATAATGTTATCACTATTGATCTGGTTCAAAATTCTTCTCAAAAA 1650

EpCAM_nt    785 ACTCAGAATGATGTGGACATAGCTGATGTGGCTTATTATTTTGAAAAAGA  834
                ||||||||||||||||||||||||||||||||||||||||||||||||||
Ovr232_nt  1651 ACTCAGAATGATGTGGACATAGCTGATGTGGCTTATTATTTTGAAAAAGA 1700

EpCAM_nt    835 TGTTAAAGGTGAATCCTTGTTTCATTCTAAGAAAATGGACCTGACAGTAA  884
                ||||||||||||||||||||||||||||||||||||||||||||||||||
Ovr232_nt  1701 TGTTAAAGGTGAATCCTTGTTTCATTCTAAGAAAATGGACCTGACAGTAA 1750

EpCAM_nt    885 ATGGGGAACAACTGGATCTGGATCCTGGTCAAACTTTAATTTATTATGTT  934
                ||||||||||||||||||||||||||||||||||||||||||||||||||
Ovr232_nt  1751 ATGGGGAACAACTGGATCTGGATCCTGGTCAAACTTTAATTTATTATGTT 1800

EpCAM_nt    935 GATGAAAAAGCACCTGAATTCTCAATGCAGGGTCTAAAAGCTGGTGTTAT  984
                ||||||||||||||||||||||||||||||||||||||||||||||||||
Ovr232_nt  1801 GATGAAAAAGCACCTGAATTCTCAATGCAGGGTCTAAAAGCTGGTGTTAT 1850

EpCAM_nt    985 TGCTGTTATTGTGGTTGTGGTGATAGCAGTTGTTGCTGGAATTGTTGTGC 1034
                ||||||||||||||||||||||||||||||||||||||||||||||||||
Ovr232_nt  1851 TGCTGTTATTGTGGTTGTGGTGATAGCAGTTGTTGCTGGAATTGTTGTGC 1900

EpCAM_nt   1035 TGGTTATTTCCAGAAAGAAGAGAATGGCAAAGTATGAGAAGGCTGAGATA 1084
                ||||||||||||||||||||||||||||||||||||||||||||||||||
Ovr232_nt  1901 TGGTTATTTCCAGAAAGAAGAGAATGGCAAAGTATGAGAAGGCTGAGATA 1950

EpCAM_nt   1085 AAGGAGATGGGTGAGATGCATAGGGAACTCAATGCATAACTATATAATTT 1134
                ||||||||||||||||||||||||||||||||||||||||||||||||||
Ovr232_nt  1951 AAGGAGATGGGTGAGATGCATAGGGAACTCAATGCATAACTATATAATTT 2000

EpCAM_nt   1135 GAAGATTATAGAAGAAGGGAAATAGCAAATGGACACAAATTACAAATGTG 1184
                ||||||||||||||||||||||||||||||||||||||||||||||||||
Ovr232_nt  2001 GAAGATTATAGAAGAAGGGAAATAGCAAATGGACACAAATTACAAATGTG 2050

EpCAM_nt   1185 TGTGCGTGGGACGAAGACATCTTTGAAGGTCATGAGTTTGTTAGTTTAAC 1234
                ||||||||||||||||||||||||||||||||||||||||||||||||||
Ovr232_nt  2051 TGTGCGTGGGACGAAGACATCTTTGAAGGTCATGAGTTTGTTAGTTTAAC 2100

EpCAM_nt   1235 ATCATATATTTGTAATAGTGAAACCTGTACTCAAAATATAAGCAGCTTGA 1284
                ||||||||||||||||||||||||||||||||||||||||||||||||||
Ovr232_nt  2101 ATCATATATTTGTAATAGTGAAACCTGTACTCAAAATATAAGCAGCTTGA 2150

EpCAM_nt   1285 AACTGGCTTTACCAATCTTGAAATTTGACCACAAGTGTCTTATATATGCA 1334
                ||||||||||||||||||||||||||||||||||||||||||||||||||
Ovr232_nt  2151 AACTGGCTTTACCAATCTTGAAATTTGACCACAAGTGTCTTATATATGCA 2200

EpCAM_nt   1335 GATCTAATGTAAAATCCAGAACTTGGACTCCATCGTTAAAATTATTTATG 1384
                ||||||||||||||||||||||||||||||||||||||||||||||||||
Ovr232_nt  2201 GATCTAATGTAAAATCCAGAACTTGGACTCCATCGTTAAAATTATTTATG 2250
```

FIGURE 1 (continued)

```
EpCAM_nt   1385 TGTAACATTCAAATGTGTGCATTAAATATGCTTCCACAGTAAAATCTGAA   1434
                ||||||||||||||||||||||||||||||||||||||||||||||||||
Ovr232_nt  2251 TGTAACATTCAAATGTGTGCATTAAATATGCTTCCACAGTAAAATCTGAA   2300

EpCAM_nt   1435 AAACTGATTTGTGATTGAAAGCTGCCTTTCTATTTACTTGAGTCTTGTAC   1484
                ||||||||||||||||||||||||||||||||||||||||||||||||||
Ovr232_nt  2301 AAACTGATTTGTGATTGAAAGCTGCCTTTCTATTTACTTGAGTCTTGTAC   2350

EpCAM_nt   1485 ATACATACTTTTTTATGAGCTATGAAATAAAACATTTTAAACTG         1528
                ||||||||||||||||||||||||||||||||||||||||||||
Ovr232_nt  2351 ATACATACTTTTTTATGAGCTATGAAATAAAACATTTTAAACTGAA       2396
```

FIGURE 2

```
EpCAM_aa     1  MAPPQVLAFGLLLAAATATFAAAQEECVCENYKLAVNCFVNNNRQCQCTS   50
                                                          ..:..
Ovr232_aa    1                                             MKSV   4

EpCAM_aa    51  VGAQNTVICSKLAAKCLVMKAEMNGSKLGRRAKPEGALQNNDGLYDPDCD  100
                :......:...:||||||||||||||||||||||||||||||||||||||
Ovr232_aa    5  IFQFGIKVSFSVAAKCLVMKAEMNGSKLGRRAKPEGALQNNDGLYDPDCD   54

EpCAM_aa   101  ESGLFKAKQCNGTSTCWCVNTAGVRRTDKDTEITCSERVRTYWIIIELKH  150
                ||||||||||||||·|||||||||||||||||||||||||||||||||||
Ovr232_aa   55  ESGLFKAKQCNGTSMCWCVNTAGVRRTDKDTEITCSERVRTYWIIIELKH  104

EpCAM_aa   151  KAREKPYDSKSLRTALQKEITTRYQLDPKFITSILYENNVITIDLVQNSS  200
                ||||||||||||||||||||||||||||||||||||||||||||||||||
Ovr232_aa  105  KAREKPYDSKSLRTALQKEITTRYQLDPKFITSILYENNVITIDLVQNSS  154

EpCAM_aa   201  QKTQNDVDIADVAYYFEKDVKGESLFHSKKMDLTVNGEQLDLDPGQTLIY  250
                ||||||||||||||||||||||||||||||||||||||||||||||||||
Ovr232_aa  155  QKTQNDVDIADVAYYFEKDVKGESLFHSKKMDLTVNGEQLDLDPGQTLIY  204

EpCAM_aa   251  YVDEKAPEFSMQGLKAGVIAVIVVVVIAVVAGIVVLVISRKKRMAKYEKA  300
                ||||||||||||||||||||||||||||||||||||||||||||||||||
Ovr232_aa  205  YVDEKAPEFSMQGLKAGVIAVIVVVVIAVVAGIVVLVISRKKRMAKYEKA  254

EpCAM_aa   301  EIKEMGEMHRELNA                                      314
                ||||||||||||||
Ovr232_aa  255  EIKEMGEMHRELNA                                      268
```

FIGURE 3

```
EpCAM_nt        1                                                                    0
Ovr232V1_nt     1   CAGATCTCAATTATCTAATTGCAATTGCAACGAGAACCAAAGCAGGGGAG              50

EpCAM_nt        1                                                                    0
Ovr232V1_nt    51   CAGAGACAAACAATTTCTGAGGTAACCAGATGGCTTTATTAACTCAAGTT             100

EpCAM_nt        1                                                                    0
Ovr232V1_nt   101   CTCACCTAAAATTGCCCTCAAGAATCCTGTGGGAATGGGTTGCAGTGGTG             150

EpCAM_nt        1                                                                    0
Ovr232V1_nt   151   TGGCCCTGGATTCACAACCGACAGAGCTTCTGAATTCTGAGTGATCTGTA             200

EpCAM_nt        1                                                                    0
Ovr232V1_nt   201   CACAAACACACCTCTGCCTGGGTTACACGCCTCCACGTTCCTCTATCCAG             250

EpCAM_nt        1                                                                    0
Ovr232V1_nt   251   TTCCCGCACCCTTCCCCCCAGGCCCCATTCTTCAAGGCTTCAGAGCAGCG             300

EpCAM_nt        1                                                                    0
Ovr232V1_nt   301   CTCCTCCGGTTAAAAGGAAGTCTCAGCACAGAATCTTCAAACCTCCTCGG             350

EpCAM_nt        1                                                                    0
Ovr232V1_nt   351   AGGCCACCAAAGATCCCTAACGCCGCCATGGAGACGAAGCACCTGGGGCG             400

EpCAM_nt        1                                                                    0
Ovr232V1_nt   401   GGGCGGAGCGGGGCGCGCGGGCCCACACCTGTGGAGAGGGCCGCGCCCCA             450

EpCAM_nt        1                                                                    0
Ovr232V1_nt   451   ACTGCAGCGCCGGGGCTGGGGGAGGGGAGCCTACTCACTCCCCCAACTCC             500

EpCAM_nt        1                                         CGGCGAGCGAGCACCTTCGACG      22
                                                          ||||·||
Ovr232V1_nt   501   CGGGCGGTGACTCATCAACGAGCACCAGCGGCCAG---------------             535

EpCAM_nt       23   CGGTCCGGGGACCCCCTCGTCGCTGTCCTCCCGACGCGGACCCGCGTGCC              72
Ovr232V1_nt   536   --------------------------------------------------             535

EpCAM_nt       73   CCAGGCCTCGCGCTGCCCGGCCGGCTCCTCGTGTCCCACTCCCGGCGCAC             122
Ovr232V1_nt   536   --------------------------------------------------             535

EpCAM_nt      123   GCCCTCCCGCGAGTCCCGGGCCCCTCCCGCGCCCCTCTTCTCGGCGCGCG             172
Ovr232V1_nt   536   --------------------------------------------------             535

EpCAM_nt      173   CGCAGCATGGCGCCCCCGCAGGTCCTCGCGTTCGGGCTTCTGCTTGCCGC             222
Ovr232V1_nt   536   --------------------------------------------------             535
```

FIGURE 3 (continued)

```
EpCAM_nt     223 GGCGACGGCGACTTTTGCCGCAGCTCAGGAAGAATGTGTCTGTGAAAACT  272
                                            ||||||||||||||||||||||
Ovr232V1_nt  536 ----------------------------AGAATGTGTCTGTGAAAACT  555

EpCAM_nt     273 ACAAGCTGGCCGTAAACTGCTTTGTAATAATAATCGTCAATGCCAGTGT  322
                 ||||||||||||||||||||||||||||||||||||||||||||||||||
Ovr232V1_nt  556 ACAAGCTGGCCGTAAACTGCTTTGTAATAATAATCGTCAATGCCAGTGT  605

EpCAM_nt     323 ACTTCAGTTGGTGCACAAAATACTGTCATTTGCTCAAAGCTGGCTGCCAA  372
                 ||||||||||||||||||||||||||||||||||||||||||||||||||
Ovr232V1_nt  606 ACTTCAGTTGGTGCACAAAATACTGTCATTTGCTCAAAGCTGGCTGCCAA  655

EpCAM_nt     373 ATGTTTGGTGATGAAGGCAGAAATGAATGGCTCAAAACTTGGGAGAAGAG  422
                 ||||||||||||||||||||||||||||||||||||||||||||||||||
Ovr232V1_nt  656 ATGTTTGGTGATGAAGGCAGAAATGAATGGCTCAAAACTTGGGAGAAGAG  705

EpCAM_nt     423 CAAAACCTGAAGGGGCCCTCCAGAACAATGATGGGCTTTATGATCCTGAC  472
                 ||||||||||||||||||||||||||||||||||||||||||||||||||
Ovr232V1_nt  706 CAAAACCTGAAGGGGCCCTCCAGAACAATGATGGGCTTTATGATCCTGAC  755

EpCAM_nt     473 TGCGATGAGAGCGGGCTCTTTAAGGCCAAGCAGTGCAACGGCACCTCCAC  522
                 |||||||||||||||||||||||||||||||||||||||||||||||||·
Ovr232V1_nt  756 TGCGATGAGAGCGGGCTCTTTAAGGCCAAGCAGTGCAACGGCACCTCCAT  805

EpCAM_nt     523 GTGCTGGTGTGTGAACACTGCTGGGGTCAGAAGAACAGACAAGGACACTG  572
                 ||||||||||||||||||||||||||||||||||||||||||||||||||
Ovr232V1_nt  806 GTGCTGGTGTGTGAACACTGCTGGGGTCAGAAGAACAGACAAGGACACTG  855

EpCAM_nt     573 AAATAACCTGCTCTGAGCGAGTGAGAACCTACTGGATCATCATTGAACTA  622
                 ||||||||||||||||||||||||||||||||||||||||||||||||||
Ovr232V1_nt  856 AAATAACCTGCTCTGAGCGAGTGAGAACCTACTGGATCATCATTGAACTA  905

EpCAM_nt     623 AAACACAAAGCAAGAGAAAAACCTTATGATAGTAAAAGTTTGCGGACTGC  672
                 ||||||||||||||||||||||||||||||||||||||||||||||||||
Ovr232V1_nt  906 AAACACAAAGCAAGAGAAAAACCTTATGATAGTAAAAGTTTGCGGACTGC  955

EpCAM_nt     673 ACTTCAGAAGGAGATCACAACGCGTTATCAACTGGATCCAAAATTTATCA  722
                 ||||||||||||||||||||||||||||||||||||||||||||||||||
Ovr232V1_nt  956 ACTTCAGAAGGAGATCACAACGCGTTATCAACTGGATCCAAAATTTATCA 1005

EpCAM_nt     723 CGAGTATTTTGTATGAGAATAATGTTATCACTATTGATCTGGTTCAAAAT  772
                 ||||||||||||||||||||||||||||||||||||||||||||||||||
Ovr232V1_nt 1006 CGAGTATTTTGTATGAGAATAATGTTATCACTATTGATCTGGTTCAAAAT 1055

EpCAM_nt     773 TCTTCTCAAAAAACTCAGAATGATGTGGACATAGCTGATGTGGCTTATTA  822
                 ||||||||||||||||||||||||||||||||||||||||||||||||||
Ovr232V1_nt 1056 TCTTCTCAAAAAACTCAGAATGATGTGGACATAGCTGATGTGGCTTATTA 1105

EpCAM_nt     823 TTTTGAAAAAGATGTTAAAGGTGAATCCTTGTTTCATTCTAAGAAAATGG  872
                 ||||||||||||||||||||||||||||||||||||||||||||||||||
Ovr232V1_nt 1106 TTTTGAAAAAGATGTTAAAGGTGAATCCTTGTTTCATTCTAAGAAAATGG 1155

EpCAM_nt     873 ACCTGACAGTAAATGGGGAACAACTGGATCTGGATCCTGGTCAAACTTTA  922
                 ||||||||||||||||||||||||||||||||||||||||||||||||||
Ovr232V1_nt 1156 ACCTGACAGTAAATGGGGAACAACTGGATCTGGATCCTGGTCAAACTTTA 1205

EpCAM_nt     923 ATTTATTATGTTGATGAAAAAGCACCTGAATTCTCAATGCAGGGTCTAAA  972
                 ||||||||||||||||||||||||||||||||||||||||||||||||||
Ovr232V1_nt 1206 ATTTATTATGTTGATGAAAAAGCACCTGAATTCTCAATGCAGGGTCTAAA 1255
```

FIGURE 3 (continued)

```
EpCAM_nt      973 AGCTGGTGTTATTGCTGTTATTGTGGTTGTGGTGATAGCAGTTGTTGCTG 1022
                  ||||||||||||||||||||||||||||||||||||||||||||||||||
Ovr232V1_nt  1256 AGCTGGTGTTATTGCTGTTATTGTGGTTGTGGTGATAGCAGTTGTTGCTG 1305

EpCAM_nt     1023 GAATTGTTGTGCTGGTTATTTCCAGAAAGAAGAGAATGGCAAAGTATGAG 1072
                  ||||||||||||||||||||||||||||||||||||||||||||||||||
Ovr232V1_nt  1306 GAATTGTTGTGCTGGTTATTTCCAGAAAGAAGAGAATGGCAAAGTATGAG 1355

EpCAM_nt     1073 AAGGCTGAGATAAAGGAGATGGGTGAGATGCATAGGGAACTCAATGCATA 1122
                  ||||||||||||||||||||||||||||||||||||||||||||||||||
Ovr232V1_nt  1356 AAGGCTGAGATAAAGGAGATGGGTGAGATGCATAGGGAACTCAATGCATA 1405

EpCAM_nt     1123 ACTATATAATTTGAAGATTATAGAAGAAGGGAAATAGCAAATGGACACAA 1172
                  ||||||||||||||||||||||||||||||||||||||||||||||||||
Ovr232V1_nt  1406 ACTATATAATTTGAAGATTATAGAAGAAGGGAAATAGCAAATGGACACAA 1455

EpCAM_nt     1173 ATTACAAATGTGTGTGCGTGGGACGAAGACATCTTTGAAGGTCATGAGTT 1222
                  ||||||||||||||||||||||||||||||||||||||||||||||||||
Ovr232V1_nt  1456 ATTACAAATGTGTGTGCGTGGGACGAAGACATCTTTGAAGGTCATGAGTT 1505

EpCAM_nt     1223 TGTTAGTTTAACATCATATATTTGTAATAGTGAAACCTGTACTCAAAATA 1272
                  ||||||||||||||||||||||||||||||||||||||||||||||||||
Ovr232V1_nt  1506 TGTTAGTTTAACATCATATATTTGTAATAGTGAAACCTGTACTCAAAATA 1555

EpCAM_nt     1273 TAAGCAGCTTGAAACTGGCTTTACCAATCTTGAAATTTGACCACAAGTGT 1322
                  ||||||||||||||||||||||||||||||||||||||||||||||||||
Ovr232V1_nt  1556 TAAGCAGCTTGAAACTGGCTTTACCAATCTTGAAATTTGACCACAAGTGT 1605

EpCAM_nt     1323 CTTATATATGCAGATCTAATGTAAAATCCAGAACTTGGACTCCATCGTTA 1372
                  ||||||||||||||||||||||||||||||||||||||||||||||||||
Ovr232V1_nt  1606 CTTATATATGCAGATCTAATGTAAAATCCAGAACTTGGACTCCATCGTTA 1655

EpCAM_nt     1373 AAATTATTTATGTGTAACATTCAAATGTGTGCATTAAATATGCTTCCACA 1422
                  ||||||||||||||||||||||||||||||||||||||||||||||||||
Ovr232V1_nt  1656 AAATTATTTATGTGTAACATTCAAATGTGTGCATTAAATATGCTTCCACA 1705

EpCAM_nt     1423 GTAAAATCTGAAAAACTGATTTGTGATTGAAAGCTGCCTTTCTATTTACT 1472
                  ||||||||||||||||||||||||||||||||||||||||||||||||||
Ovr232V1_nt  1706 GTAAAATCTGAAAAACTGATTTGTGATTGAAAGCTGCCTTTCTATTTACT 1755

EpCAM_nt     1473 TGAGTCTTGTACATACATACTTTTTTATGAGCTATGAAATAAAACATTTT 1522
                  ||||||||||||||||||||||||||||||||||||||||||||||||||
Ovr232V1_nt  1756 TGAGTCTTGTACATACATACTTTTTTATGAGCTATGAAATAAAACATTTT 1805

EpCAM_nt     1523 AAACTG                                             1528
                  ||||||
Ovr232V1_nt  1806 AAACTGAA                                           1813
```

FIGURE 4

```
EpCAM_aa        1 MAPPQVLAFGLLLAAATATFAA                                22
                  .|............|.|...|.
Ovr232V1_aa     1 METKHLGRGGAGRAGPHLWRGPRPNCSAGAGGGEPTHSPNSRAVTHQRAP    50

EpCAM_aa       23 AQEECVCENYKLAVNCFVNNNRQCQCTSVGAQNTVICSKLAAKCLVMKAE    72
                  |..|||||||||||||||||||||||||||||||||||||||||||||||
Ovr232V1_aa    51 AARECVCENYKLAVNCFVNNNRQCQCTSVGAQNTVICSKLAAKCLVMKAE   100

EpCAM_aa       73 MNGSKLGRRAKPEGALQNNDGLYDPDCDESGLFKAKQCNGTSTCWCVNTA   122
                  |||||||||||||||||||||||||||||||||||||||||.|||||||
Ovr232V1_aa   101 MNGSKLGRRAKPEGALQNNDGLYDPDCDESGLFKAKQCNGTSMCWCVNTA   150

EpCAM_aa      123 GVRRTDKDTEITCSERVRTYWIIIELKHKAREKPYDSKSLRTALQKEITT   172
                  |||||||||||||||||||||||||||||||||||||||||||||||||
Ovr232V1_aa   151 GVRRTDKDTEITCSERVRTYWIIIELKHKAREKPYDSKSLRTALQKEITT   200

EpCAM_aa      173 RYQLDPKFITSILYENNVITIDLVQNSSQKTQNDVDIADVAYYFEKDVKG   222
                  |||||||||||||||||||||||||||||||||||||||||||||||||
Ovr232V1_aa   201 RYQLDPKFITSILYENNVITIDLVQNSSQKTQNDVDIADVAYYFEKDVKG   250

EpCAM_aa      223 ESLFHSKKMDLTVNGEQLDLDPGQTLIYYVDEKAPEFSMQGLKAGVIAVI   272
                  |||||||||||||||||||||||||||||||||||||||||||||||||
Ovr232V1_aa   251 ESLFHSKKMDLTVNGEQLDLDPGQTLIYYVDEKAPEFSMQGLKAGVIAVI   300

EpCAM_aa      273 VVVVIAVVAGIVVLVISRKKRMAKYEKAEIKEMGEMHRELNA           314
                  ||||||||||||||||||||||||||||||||||||||||||
Ovr232V1_aa   301 VVVVIAVVAGIVVLVISRKKRMAKYEKAEIKEMGEMHRELNA           342
```

FIGURE 5

```
EpCAM_nt       1                                                                0
Ovr232V2_nt    1  CAGATCTCAATTATCTAATTGCAATTGCAACGAGAACCAAAGCAGGGGAG            0

EpCAM_nt       1                                                                0
Ovr232V2_nt   51  CAGAGACAAACAATTTCTGAGGTAACCAGATGGCTTTATTAACTCAAGTT          100

EpCAM_nt       1                                                                0
Ovr232V2_nt  101  CTCACCTAAAATTGCCCTCAAGAATCCTGTGGGAATGGGTTGCAGTGGTG          150

EpCAM_nt       1                                                                0
Ovr232V2_nt  151  TGGCCCTGGATTCACAACCGACAGAGCTTCTGAATTCTGAGTGATCTGTA          200

EpCAM_nt       1                                                                0
Ovr232V2_nt  201  CACAAACACACCTCTGCCTGGGTTACACGCCTCCACGTTCCTCTATCCAG          250

EpCAM_nt       1                                                                0
Ovr232V2_nt  251  TTCCCGCACCCTTCCCCCCAGGCCCCATTCTTCAAGGCTTCAGAGCAGCG          300

EpCAM_nt       1                                                                0
Ovr232V2_nt  301  CTCCTCCGGTTAAAAGGAAGTCTCAGCACAGAATCTTCAAACCTCCTCGG          350

EpCAM_nt       1                                                                0
Ovr232V2_nt  351  AGGCCACCAAAGATCCCTAACGCCGCCATGGAGACGAAGCACCTGGGGCG          400

EpCAM_nt       1                                                                0
Ovr232V2_nt  401  GGGCGGAGCGGGGCGCGCGGGCCCACACCTGTGGAGAGGGCCGCGCCCCA          450

EpCAM_nt       1                                                                0
Ovr232V2_nt  451  ACTGCAGCGCCGGGGCTGGGGGAGGGGAGCCTACTCACTCCCCCAACTCC          500

EpCAM_nt       1                                                                0
Ovr232V2_nt  501  CGGGCGGTGACTCATCAACGAGCACCAGCGGCCAGAGGTGAGCAGTCCCG          550

EpCAM_nt       1                                                                0
Ovr232V2_nt  551  GGAAGGGGCCGAGAGGCGGGGCCGCCAGGTCGGGCAGGTGTGCGCTCCGC          600

EpCAM_nt       1  CGGCGAGCGAGCACCTTCGAC                                        21
                  |||||||||||||||||||||
Ovr232V2_nt  601  CCCGCCGCGCGCACAGAGCGCTAGTCCTTCGGCGAGCGAGCACCTTCGAC          650

EpCAM_nt      22  GCGGTCCGGGGACCCCCTCGTCGCTGTCCTCCCGACGCGGACCCGCGTGC           71
                  ||||||||||||||||||||||||||||||||||||||||||||||||||
Ovr232V2_nt  651  GCGGTCCGGGGACCCCCTCGTCGCTGTCCTCCCGACGCGGACCCGCGTGC          700

EpCAM_nt      72  CCCAGGCCTCGCGCTGCCCGGCCGGCTCCTCGTGTCCCACTCCCGGCGCA           21
                  ||||||||||||||||||||||||||||||||||||||||||||||||||
Ovr232V2_nt  701  CCCAGGCCTCGCGCTGCCCGGCCGGCTCCTCGTGTCCCACTCCCGGCGCA          750
```

FIGURE 5 (continued)

```
EpCAM_nt      122 CGCCCTCCCGCGAGTCCCGGGCCCCTCCCGCGCCCCTCTTCTCGGCGCGC  171
                  ||||||||||||||||||||||||||||||||||||||||||||||||||
Ovr232V2_nt   751 CGCCCTCCCGCGAGTCCCGGGCCCCTCCCGCGCCCCTCTTCTCGGCGCGC  800

EpCAM_nt      172 GCGCAGCATGGCGCCCCGCAGGTCCTCGCGTTCGGGCTTCTGCTTGCCG   221
                  ||||||||||||||||||||||||||||||||||||||||||||||||||
Ovr232V2_nt   801 GCGCAGCATGGCGCCCCGCAGGTCCTCGCGTTCGGGCTTCTGCTTGCCG   850

EpCAM_nt      222 CGGCGACGGCGACTTTTGCCGCAGCTCAGGAAGAATGTGTCTGTGAAAAC  271
                  ||||||||||||||||||||||||||||||||||||||||||||||||||
Ovr232V2_nt   851 CGGCGACGGCGACTTTTGCCGCAGCTCAGGAAGAATGTGTCTGTGAAAAC  900

EpCAM_nt      272 TACAAGCTGGCCGTAAACTGCTTTGTGAATAATAATCGTCAATGCCAGTG  321
                  ||||||||||||||||||||||||||||||||||||||||||||||||||
Ovr232V2_nt   901 TACAAGCTGGCCGTAAACTGCTTTGTGAATAATAATCGTCAATGCCAGTG  950

EpCAM_nt      322 TACTTCAGTTGGTGCACAAAATACTGTCATTTGCTCAAAGCTGGCTGCCA  371
                  ||||||||||||||||||||||||||||||||||||||||||||||||||
Ovr232V2_nt   951 TACTTCAGTTGGTGCACAAAATACTGTCATTTGCTCAAAGCTGGCTGCCA 1000

EpCAM_nt      372 AATGTTTGGTGATGAAGGCAGAAATGAATGGCTCAAAACTTGGGAGAAGA  421
                  ||||||||||||||||||||||||||||||||||||||||||||||||||
Ovr232V2_nt  1001 AATGTTTGGTGATGAAGGCAGAAATGAATGGCTCAAAACTTGGGAGAAGA 1050

EpCAM_nt      422 GCAAAACCTGAAGGGGCCCTCCAGAACAATGATGGGCTTTATGATCCTGA  471
                  ||||||||||||||||||||||||||||||||||||||||||||||||||
Ovr232V2_nt  1051 GCAAAACCTGAAGGGGCCCTCCAGAACAATGATGGGCTTTATGATCCTGA 1100

EpCAM_nt      472 CTGCGATGAGAGCGGGCTCTTTAAGGCCAAGCAGTGCAACGGCACCTCCA  521
                  ||||||||||||||||||||||||||||||||||||||||||||||||||
Ovr232V2_nt  1101 CTGCGATGAGAGCGGGCTCTTTAAGGCCAAGCAGTGCAACGGCACCTCCA 1150

EpCAM_nt      522 CGTGCTGGTGTGTGAACACTGCTGGGGTCAGAAGAACAGACAAGGACACT  571
                  -|||||||||||||||||||||||||||||||||||||||||||||||||
Ovr232V2_nt  1151 TGTGCTGGTGTGTGAACACTGCTGGGGTCAGAAGAACAGACAAGGACACT 1200

EpCAM_nt      572 GAAATAACCTGCTCTGAGCGAGTGAGAACCTACTGGATCATCATTGAACT  621
                  ||||||||||||||||||||||||||||||||||||||||||||||||||
Ovr232V2_nt  1201 GAAATAACCTGCTCTGAGCGAGTGAGAACCTACTGGATCATCATTGAACT 1250

EpCAM_nt      622 AAAACACAAAGCAAGAGAAAAACCTTATGATAGTAAAAGTTTGCGGACTG  671
                  ||||||||||||||||||||||||||||||||||||||||||||||||||
Ovr232V2_nt  1251 AAAACACAAAGCAAGAGAAAAACCTTATGATAGTAAAAGTTTGCGGACTG 1300

EpCAM_nt      672 CACTTCAGAAGGAGATCACAACGCGTTATCAACTGGATCCAAAATTTATC  721
                  ||||||||||||||||||||||||||||||||||||||||||||||||||
Ovr232V2_nt  1301 CACTTCAGAAGGAGATCACAACGCGTTATCAACTGGATCCAAAATTTATC 1350

EpCAM_nt      722 ACGAGTATTTTGTATGAGAATAATGTTATCACTATTGATCTGGTTCAAAA  771
                  ||||||||||||||||||||||||||||||||||||||||||||||||||
Ovr232V2_nt  1351 ACGAGTATTTTGTATGAGAATAATGTTATCACTATTGATCTGGTTCAAAA 1400

EpCAM_nt      772 TTCTTCTCAAAAAACTCAGAATGATGTGGACATAGCTGATGTGGCTTATT  821
                  ||||||||||||||||||||||||||||||||||||||||||||||||||
Ovr232V2_nt  1401 TTCTTCTCAAAAAACTCAGAATGATGTGGACATAGCTGATGTGGCTTATT 1450

EpCAM_nt      822 ATTTTGAAAAAGATGTTAAAGGTGAATCCTTGTTTCATTCTAAGAAAATG  871
                  ||||||||||||||..|....||......|||.|||..|.||..|...|.|
Ovr232V2_nt  1451 ATTTTGAAAAAGATGATGTGAGTATCATCTTCTTTATTCCTGTGTTCAGG 1500
```

FIGURE 5 (continued)

```
EpCAM_nt      872 GACCTGACAGTAAATGGGGAACAACTGGATCTGGATCCTGGTCAAACTTT   921
                  .|..|.........|||....|........|..|..||...........|||
Ovr232V2_nt  1501 AATGTAGTCTATCATGCCTCAATGAATTAAATATATTTCATCACCTTTTT  1550

EpCAM_nt      922 AATTTATTATGTTGATGAAAAAGCACCTGAATTCTCAATGCAGGGTCTAA   971
                  |.....|||..........|||......|.......|..|..|...|.|..
Ovr232V2_nt  1551 ATCCACTTACAGATCAACCAAATGGTTCGCTGCTGCCGTTAATTTTGTCC  1600

EpCAM_nt      972 AAGCTGGTGTTATTGCTGTTATTGTGGTTGTGGTGATAGCAGTTGTTGCT  1021
                  ...|||....|.........|.|||....|.||...||....|....|..|
Ovr232V2_nt  1601 TCCCTGTCACTCACATGCATCTTGCTTGTTTGTATATTTATGCCTCTTAT  1650

EpCAM_nt     1022 GGAATTGTTGTGCTGGTTATTTCCAGAAAGAAGAGAATGGCAAAGTATGA  1071
                  ..||||||||.|||.....||.||.............||..........|.|
Ovr232V2_nt  1651 CAAATTGTTCTGCCTAAAATATCTCCCCTCTTTCTTATAATTCTTATTTA  1700

EpCAM_nt     1072 GAAGGCTGAGATAAAGGAGATGGGTGAGATGCATAGGGAACTCAATGCAT  1121
                  ..|...............|..|.|.|........|||.|....|.|.|||
Ovr232V2_nt  1701 TTATCTACTTGGTGGTTACTTAGTTTGTGCATATATGCTCCCCTATG---  1747

EpCAM_nt     1122 AACTATATAATTTGAAGATTATAGAAGAAGGGAAATAGCAAATGGACACA  1171
                  |..|.|||||||||..|.|....|.|....|..|||.|..|.....||..|
Ovr232V2_nt  1748 ATATTTATAATTTACACAAATAAAAGTCTGTTAAAAAGACTGTAACTGA   1797

EpCAM_nt     1172 AATTACAAATGTGTGTGCGTGGGACGAAGACATCTTTGAAGGTCATGAGT  1221
                  .||.|..||..|.|.|...||..||....|.||.||..|..|...|
Ovr232V2_nt  1798 TATGATTAAAATATTTTGTTGAAACTTTAATATATTATAGTGAGGT      1843

EpCAM_nt     1222 TTGTTAGTTTAACATCATATATTTGTAATAGTGAAACCTGTACTCAAAAT  1271

Ovr232V2_nt  1844                                                    1843

EpCAM_nt     1272 ATAAGCAGCTTGAAACTGGCTTTACCAATCTTGAAATTTGACCACAAGTG  1321

Ovr232V2_nt  1844                                                    1843

EpCAM_nt     1322 TCTTATATATGCAGATCTAATGTAAAATCCAGAACTTGGACTCCATCGTT  1371

Ovr232V2_nt  1844                                                    1843

EpCAM_nt     1372 AAAATTATTTATGTGTAACATTCAAATGTGTGCATTAAATATGCTTCCAC  1421

Ovr232V2_nt  1844
1843

EpCAM_nt     1422 AGTAAAATCTGAAAAACTGATTTGTGATTGAAAGCTGCCTTTCTATTTAC  1471

Ovr232V2_nt  1844                                                    1843

EpCAM_nt     1472 TTGAGTCTTGTACATACATACTTTTTTATGAGCTATGAAATAAAACATTT  1521

Ovr232V2_nt  1844                                                    1843

EpCAM_nt     1522 TAAACTG                                             1528

Ovr232V2_nt  1844                                                    1843
```

FIGURE 6

```
EpCAM_aa      1 MAPPQVLAFGLLLAAATATFAAAQEECVCENYKLAVNCFVNNNRQCQCTS    50
                ||||||||||||||||||||||||||||||||||||||||||||||||||
Ovr232V2_aa   1 MAPPQVLAFGLLLAAATATFAAAQEECVCENYKLAVNCFVNNNRQCQCTS    50

EpCAM_aa     51 VGAQNTVICSKLAAKCLVMKAEMNGSKLGRRAKPEGALQNNDGLYDPDCD   100
                ||||||||||||||||||||||||||||||||||||||||||||||||||
Ovr232V2_aa  51 VGAQNTVICSKLAAKCLVMKAEMNGSKLGRRAKPEGALQNNDGLYDPDCD   100

EpCAM_aa    101 ESGLFKAKQCNGTSTCWCVNTAGVRRTDKDTEITCSERVRTYWIIIELKH   150
                |||||||||||||| |||||||||||||||||||||||||||||||||||
Ovr232V2_aa 101 ESGLFKAKQCNGTSMCWCVNTAGVRRTDKDTEITCSERVRTYWIIIELKH   150

EpCAM_aa    151 KAREKPYDSKSLRTALQKEITTRYQLDPKFITSILYENNVITIDLVQNSS   200
                ||||||||||||||||||||||||||||||||||||||||||||||||||
Ovr232V2_aa 151 KAREKPYDSKSLRTALQKEITTRYQLDPKFITSILYENNVITIDLVQNSS   200

EpCAM_aa    201 QKTQNDVDIADVAYYFEKDVKGESLFHSKKMDLTVNGEQLDLDPGQTLIY   250
                ||||||||||||||||||||......|.....:..:....
Ovr232V2_aa 201 QKTQNDVDIADVAYYFEKDDVSIIFFIPVFRNVVYHASMN             240

EpCAM_aa    251 YVDEKAPEFSMQGLKAGVIAVIVVVVIAVVAGIVVLVISRKKRMAKYEKA   300

Ovr232V2_aa 241                                                      240

EpCAM_aa    301 EIKEMGEMHRELNA                                       314

Ovr232V2_aa 241                                                      240
```

FIGURE 7

```
EpCAM_nt       1                                                              0

Ovr232V3_nt    1  CAGATCTCAATTATCTAATTGCAATTGCAACGAGAACCAAAGCAGGGGAG         50

EpCAM_nt       1                                                              0

Ovr232V3_nt   51  CAGAGACAAACAATTTCTGAGGTAACCAGATGGCTTTATTAACTCAAGTT        100

EpCAM_nt       1                                                              0

Ovr232V3_nt  101  CTCACCTAAAATTGCCCTCAAGAATCCTGTGGGAATGGGTTGCAGTGGTG        150

EpCAM_nt       1                                                              0

Ovr232V3_nt  151  TGGCCCTGGATTCACAACCGACAGAGCTTCTGAATTCTGAGTGATCTGTA        200

EpCAM_nt       1                                                              0

Ovr232V3_nt  201  CACAAACACACCTCTGCCTGGGTTACACGCCTCCACGTTCCTCTATCCAG         50

EpCAM_nt       1                                                              0

Ovr232V3_nt  251  TTCCCGCACCCTTCCCCCCAGGCCCCATTCTTCAAGGCTTCAGAGCAGCG        300

EpCAM_nt       1                                                              0

Ovr232V3_nt  301  CTCCTCCGGTTAAAAGGAAGTCTCAGCACAGAATCTTCAAACCTCCTCGG        350

EpCAM_nt       1                                                              0

Ovr232V3_nt  351  AGGCCACCAAAGATCCCTAACGCCGCCATGGAGACGAAGCACCTGGGGCG        400

EpCAM_nt       1                                                              0

Ovr232V3_nt  401  GGGCGGAGCGGGGCGCGCGGGCCCACACCTGTGGAGAGGGCCGCGCCCCA        450

EpCAM_nt       1                                                              0

Ovr232V3_nt  451  ACTGCAGCGCCGGGGCTGGGGGAGGGGAGCCTACTCACTCCCCCAACTCC        500

EpCAM_nt       1                                                              0

Ovr232V3_nt  501  CGGGCGGTGACTCATCAACGAGCACCAGCGGCCAGAGGTGAGCAGTCCCG        550

EpCAM_nt       1                                                              0

Ovr232V3_nt  551  GGAAGGGGCCGAGAGGCGGGGCCGCCAGGTCGGGCAGGTGTGCGCTCCGC        600

EpCAM_nt       1  CGGCGAGCGAGCACCTTCGAC                                        21
                  |||||||||||||||||||||
Ovr232V3_nt  601  CCCGCCGCGCGCACAGAGCGCTAGTCCTTCGGCGAGCGAGCACCTTCGAC        650

EpCAM_nt      22  GCGGTCCGGGGACCCCCTCGTCGCTGTCCTCCCGACGCGGACCCGCGTGC         71
                  ||||||||||||||||||||||||||||||||||||||||||||||||||
Ovr232V3_nt  651  GCGGTCCGGGGACCCCCTCGTCGCTGTCCTCCCGACGCGGACCCGCGTGC        700

EpCAM_nt      72  CCCAGGCCTCGCGCTGCCCGGCCGGCTCCTCGTGTCCCACTCCCGGCGCA        121
                  ||||||||||||||||||||||||||||||||||||||||||||||||||
Ovr232V3_nt  701  CCCAGGCCTCGCGCTGCCCGGCCGGCTCCTCGTGTCCCACTCCCGGCGCA        750
```

FIGURE 7 (continued)

```
EpCAM_nt      122 CGCCCTCCCGCGAGTCCCGGGCCCCTCCCGCGCCCCTCTTCTCGGCGCGC  171
                  ||||||||||||||||||||||||||||||||||||||||||||||||||
Ovr232V3_nt   751 CGCCCTCCCGCGAGTCCCGGGCCCCTCCCGCGCCCCTCTTCTCGGCGCGC  800

EpCAM_nt      172 GCGCAGCATGGCGCCCCCGCAGGTCCTCGCGTTCGGGCTTCTGCTTGCCG  221
                  ||||||||||||||||||||||||||||||||||||||||||||||||||
Ovr232V3_nt   801 GCGCAGCATGGCGCCCCCGCAGGTCCTCGCGTTCGGGCTTCTGCTTGCCG  850

EpCAM_nt      222 CGGCGACGGCGACTTTTGCCGCAGCTCAGGAA----------------- 253
                  |||||||||||||||||||||||||||||||||
Ovr232V3_nt   851 CGGCGACGGCGACTTTTGCCGCAGCTCAGGAAGGTGAGGCGCGGATTGGA  900

EpCAM_nt      254 -------------------------------------------------  253

Ovr232V3_nt   901 GCAGAGTTGTGGAGCTGGGCTGGGCTGGGGGGCAGCGGCCCCCGGCCCTC  950

EpCAM_nt      254 -------------------------------------------------  253

Ovr232V3_nt   951 GGCCCCCGAAACGGGCATAATAGGGAGGGGACCAAGAGGCCGCGCTTTCC 1000

EpCAM_nt      254 -------------------------------------------------  253

Ovr232V3_nt  1001 AGCGTGGAGACCGGACGGTGCGGCCGTGCTCCGGCTCAGGCCCTCCGCGC 1050

EpCAM_nt      254 -------------------------------------------------  253

Ovr232V3_nt  1051 GGTAGGAAACGGCGAGGGCCGTCCCGGGGAGCAGCCTCACTTCGCAGCTT 1100

EpCAM_nt      254 ----------GAATGTGTCTGTGAAAACTACAAGCTGGCCGTAAACTGCT  293
                            ||||||||||||||||||||||||||||||||||||||||
Ovr232V3_nt  1101 TGCTCGCCTTGAATGTGTCTGTGAAAACTACAAGCTGGCCGTAAACTGCT 1150

EpCAM_nt      294 TTGTGAATAATAATCGTCAATGCCAGTGTACTTCAGTTGGTGCACAAAAT  343
                  ||||||||||||||||||||||||||||||||||||||||||||||||||
Ovr232V3_nt  1151 TTGTGAATAATAATCGTCAATGCCAGTGTACTTCAGTTGGTGCACAAAAT 1200

EpCAM_nt      344 ACTGTCATTTGCTCAAAGCTGGCTGCCAAATGTTTGGTGATGAAGGCAGA  393
                  ||||||||||||||||||||||||||||||||||||||||||||||||||
Ovr232V3_nt  1201 ACTGTCATTTGCTCAAAGCTGGCTGCCAAATGTTTGGTGATGAAGGCAGA 1250

EpCAM_nt      394 AATGAATGGCTCAAAACTTGGGAGAAGAGCAAAACCTGAAGGGGCCCTCC  443
                  ||||||||||||||||||||||||||||||||||||||||||||||||||
Ovr232V3_nt  1251 AATGAATGGCTCAAAACTTGGGAGAAGAGCAAAACCTGAAGGGGCCCTCC 1300

EpCAM_nt      444 AGAACAATGATGGGCTTTATGATCCTGACTGCGATGAGAGCGGGCTCTTT  493
                  ||||||||||||||||||||||||||||||||||||||||||||||||||
Ovr232V3_nt  1301 AGAACAATGATGGGCTTTATGATCCTGACTGCGATGAGAGCGGGCTCTTT 1350

EpCAM_nt      494 AAGGCCAAGCAGTGCAACGGCACCTCCACGTGCTGGTGTGTGAACACTGC  543
                  |||||||||||||||||||||||||||||-||||||||||||||||||||
Ovr232V3_nt  1351 AAGGCCAAGCAGTGCAACGGCACCTCCATGTGCTGGTGTGTGAACACTGC 1400

EpCAM_nt      544 TGGGGTCAGAAGAACAGACAAGGACACTGAAATAACCTGCTCTGAGCGAG  593
                  ||||||||||||||||||||||||||||||||||||||||||||||||||
Ovr232V3_nt  1401 TGGGGTCAGAAGAACAGACAAGGACACTGAAATAACCTGCTCTGAGCGAG 1450

EpCAM_nt      594 TGAGAACCTACTGGATCATCATTGAACTAAAACACAAAGCAAGAGAAAAA  643
                  ||||||||||||||||||||||||||||||||||||||||||||||||||
Ovr232V3_nt  1451 TGAGAACCTACTGGATCATCATTGAACTAAAACACAAAGCAAGAGAAAAA 1500
```

FIGURE 7 (continued)

```
EpCAM_nt       644 CCTTATGATAGTAAAAGTTTGCGGACTGCACTTCAGAAGGAGATCACAAC  693
                   ||||||||||||||||||||||||||||||||||||||||||||||||||
Ovr232V3_nt   1501 CCTTATGATAGTAAAAGTTTGCGGACTGCACTTCAGAAGGAGATCACAAC 1550

EpCAM_nt       694 GCGTTATCAACTGGATCCAAAATTTATCACGAGTATTTTGTATGAGAATA  743
                   ||||||||||||||||||||||||||||||||||||||||||||||||||
Ovr232V3_nt   1551 GCGTTATCAACTGGATCCAAAATTTATCACGAGTATTTTGTATGAGAATA 1600

EpCAM_nt       744 ATGTTATCACTATTGATCTGGTTCAAAATTCTTCTCAAAAAACTCAGAAT  793
                   ||||||||||||||||||||||||||||||||||||||||||||||||||
Ovr232V3_nt   1601 ATGTTATCACTATTGATCTGGTTCAAAATTCTTCTCAAAAAACTCAGAAT 1650

EpCAM_nt       794 GATGTGGACATAGCTGATGTGGCTTATTATTTTGAAAAGATGTTAAAGG  843
                   ||||||||||||||||||||||||||||||||||||||||||||||||||
Ovr232V3_nt   1651 GATGTGGACATAGCTGATGTGGCTTATTATTTTGAAAAGATGTTAAAGG 1700

EpCAM_nt       844 TGAATCCTTGTTTCATTCTAAGAAAATGGACCTGACAGTAAATGGGGAAC  893
                   ||||||||||||||||||||||||||||||||||||||||||||||||||
Ovr232V3_nt   1701 TGAATCCTTGTTTCATTCTAAGAAAATGGACCTGACAGTAAATGGGGAAC 1750

EpCAM_nt       894 AACTGGATCTGGATCCTGGTCAAACTTTAATTTATTATGTTGATGAAAAA  943
                   ||||||||||||||||||||||||||||||||||||||||||||||||||
Ovr232V3_nt   1751 AACTGGATCTGGATCCTGGTCAAACTTTAATTTATTATGTTGATGAAAAA 1800

EpCAM_nt       944 GCACCTGAATTCTCAATGCAGGGTCTAAAAGCTGGTGTTATTGCTGTTAT  993
                   ||||||||||||||||||||||||||||||||||||||||||||||||||
Ovr232V3_nt   1801 GCACCTGAATTCTCAATGCAGGGTCTAAAAGCTGGTGTTATTGCTGTTAT 1850

EpCAM_nt       994 TGTGGTTGTGGTGATAGCAGTTGTTGCTGGAATTGTTGTGCTGGTTATTT 1043
                   ||||||||||||||||||||||||||||||||||||||||||||||||||
Ovr232V3_nt   1851 TGTGGTTGTGGTGATAGCAGTTGTTGCTGGAATTGTTGTGCTGGTTATTT 1900

EpCAM_nt      1044 CCAGAAAGAAGAGAATGGCAAAGTATGAGAAGGCTGAGATAAAGGAGATG 1093
                   ||||||||||||||||||||||||||||||||||||||||||||||||||
Ovr232V3_nt   1901 CCAGAAAGAAGAGAATGGCAAAGTATGAGAAGGCTGAGATAAAGGAGATG 1950

EpCAM_nt      1094 GGTGAGATGCATAGGGAACTCAATGCATAACTATATAATTTGAAGATTAT 1143
                   ||||||||||||||||||||||||||||||||||||||||||||||||||
Ovr232V3_nt   1951 GGTGAGATGCATAGGGAACTCAATGCATAACTATATAATTTGAAGATTAT 2000

EpCAM_nt      1144 AGAAGAAGGGAAATAGCAAATGGACACAAATTACAAATGTGTGTGCGTGG 1193
                   ||||||||||||||||||||||||||||||||||||||||||||||||||
Ovr232V3_nt   2001 AGAAGAAGGGAAATAGCAAATGGACACAAATTACAAATGTGTGTGCGTGG 2050

EpCAM_nt      1194 GACGAAGACATCTTTGAAGGTCATGAGTTTGTTAGTTTAACATCATATAT 1243
                   ||||||||||||||||||||||||||||||||||||||||||||||||||
Ovr232V3_nt   2051 GACGAAGACATCTTTGAAGGTCATGAGTTTGTTAGTTTAACATCATATAT 2100

EpCAM_nt      1244 TTGTAATAGTGAAACCTGTACTCAAAATATAAGCAGCTTGAAACTGGCTT 1293
                   ||||||||||||||||||||||||||||||||||||||||||||||||||
Ovr232V3_nt   2101 TTGTAATAGTGAAACCTGTACTCAAAATATAAGCAGCTTGAAACTGGCTT 2150

EpCAM_nt      1294 TACCAATCTTGAAATTTGACCACAAGTGTCTTATATATGCAGATCTAATG 1343
                   ||||||||||||||||||||||||||||||||||||||||||||||||||
Ovr232V3_nt   2151 TACCAATCTTGAAATTTGACCACAAGTGTCTTATATATGCAGATCTAATG 2200

EpCAM_nt      1344 TAAAATCCAGAACTTGGACTCCATCGTTAAAATTATTTATGTGTAACATT 1393
                   ||||||||||||||||||||||||||||||||||||||||||||||||||
Ovr232V3_nt   2201 TAAAATCCAGAACTTGGACTCCATCGTTAAAATTATTTATGTGTAACATT 2250
```

FIGURE 7 (continued)

```
EpCAM_nt     1394 CAAATGTGTGCATTAAATATGCTTCCACAGTAAAATCTGAAAAACTGATT 1443
                  ||||||||||||||||||||||||||||||||||||||||||||||||||
Ovr232V3_nt  2251 CAAATGTGTGCATTAAATATGCTTCCACAGTAAAATCTGAAAAACTGATT 2300

EpCAM_nt     1444 TGTGATTGAAAGCTGCCTTTCTATTTACTTGAGTCTTGTACATACATACT 1493
                  ||||||||||||||||||||||||||||||||||||||||||||||||||
Ovr232V3_nt  2301 TGTGATTGAAAGCTGCCTTTCTATTTACTTGAGTCTTGTACATACATACT 2350

EpCAM_nt     1494 TTTTTATGAGCTATGAAATAAAACATTTTAAACTG                1528
                  |||||||||||||||||||||||||||||||||||
Ovr232V3_nt  2351 TTTTTATGAGCTATGAAATAAAACATTTTAAACTGAA              2387
```

FIGURE 8

```
EpCAM_aa       1 MAPPQVLAFGLLLAAATATFAAAQE-------------------------  25
                 |||||||||||||||||||||||||
Ovr232V3_aa    1 MAPPQVLAFGLLLAAATATFAAAQEGEARIGAKLWSWAGLGGNGPRPSAP  50

EpCAM_aa      26 --------------------------------------------------  25

Ovr232V3_aa   51 ETGIIGRGPRGRAFQRGDRTVRPCSGSGPPRGRKRRGPSRGAASLRSFAR 100

EpCAM_aa      26 -ECVCENYKLAVNCFVNNNRQCQCTSVGAQNTVICSKLAAKCLVMKAEMN  74
                  |||||||||||||||||||||||||||||||||||||||||||||||||
Ovr232V3_aa  101 LECVCENYKLAVNCFVNNNRQCQCTSVGAQNTVICSKLAAKCLVMKAEMN 150

EpCAM_aa      75 GSKLGRRAKPEGALQNNDGLYDPDCDESGLFKAKQCNGTSTCWCVNTAGV 124
                 ||||||||||||||||||||||||||||||||||||||||-|||||||||
Ovr232V3_aa  151 GSKLGRRAKPEGALQNNDGLYDPDCDESGLFKAKQCNGTSMCWCVNTAGV 200

EpCAM_aa     125 RRTDKDTEITCSERVRTYWIIIELKHKAREKPYDSKSLRTALQKEITTRY 174
                 |||||||||||||||||||||||||||||||||||||||||||||||||
Ovr232V3_aa  201 RRTDKDTEITCSERVRTYWIIIELKHKAREKPYDSKSLRTALQKEITTRY 250

EpCAM_aa     175 QLDPKFITSILYENNVITIDLVQNSSQKTQNDVDIADVAYYFEKDVKGES 224
                 |||||||||||||||||||||||||||||||||||||||||||||||||
Ovr232V3_aa  251 QLDPKFITSILYENNVITIDLVQNSSQKTQNDVDIADVAYYFEKDVKGES 300

EpCAM_aa     225 LFHSKKMDLTVNGEQLDLDPGQTLIYYVDEKAPEFSMQGLKAGVIAVIVV 274
                 |||||||||||||||||||||||||||||||||||||||||||||||||
Ovr232V3_aa  301 LFHSKKMDLTVNGEQLDLDPGQTLIYYVDEKAPEFSMQGLKAGVIAVIVV 350

EpCAM_aa     275 VVIAVVAGIVVLVISRKKRMAKYEKAEIKEMGEMHRELNA           314
                 ||||||||||||||||||||||||||||||||||||||||
Ovr232V3_aa  351 VVIAVVAGIVVLVISRKKRMAKYEKAEIKEMGEMHRELNA           390
```

FIGURE 9

```
Ovr107       1 AGAGCAAGGAAGGGCAGGGGACCTGGGAAGGAAGTTCTGGAAGGCAGTGG    50

455_051.nt.2 1                                                          0

Ovr107      51 GGTTTGAGATTGGACCCAGGGTCAAGATAGAACATGAAGGTGGGATGAGG   100

455_051.nt.2 1                                                          0

Ovr107     101 ACATGAACAGAACATGGCCAAGAAGGATCTGGGGGAGCAGCCAGGACGAG   150

455_051.nt.2 1                                                          0

Ovr107     151 GCGGAGCTGATCCGAGAGGACATCCAGGGGGCTCTGCACAATTACCGCTC   200

455_051.nt.2 1                                                          0

Ovr107     201 GGGCCGCGGGGAGCGCAGGGCGGCGGCGCTCAGGGCCACGCAGGAGGAGT   250

455_051.nt.2 1                                                          0

Ovr107     251 TGCAGCGCGACCGCTCGCCCGCCGCTGAGACCCCGCCCCTGCAGCGCCGC   300

455_051.nt.2 1                                                          0

Ovr107     301 CCGTCAGTCCGCGCAGTGATCAGCACCGTAGAGCGGGGCGCGGGCCGCGG   350

455_051.nt.2 1                                                          0

Ovr107     351 ACGACCCCAGGCGAAGCCCATTCCCGAGGCAGAGGAGGCGCAGAGGCCTG   400

455_051.nt.2 1                                                          0

Ovr107     401 AGCCGGTGGGGACCTCGAGCAA-------CGCTGACTC----GGC-CTCC   438
                  ||·|||···|||        ||||   |||    ||| ||||
455_051.nt.2 1        GATCTCTTCCAAATGTCCCCGCT--CTCCCCAGGCTCTCC    38

Ovr107     439 CCGGACCTGGGTCC---------CCGGGTCCTGACCTGGCGGTTCTGCA   479
                ||      |||         ||·|||  |||||||          ||
455_051.nt.2 39 CC---------TCCCGCCACTTGCCAGGG--CTGACCT----------CA    67

Ovr107     480 -GGCGGAGCGGGAAGTGGACATCCTGAACCACGTGTTCGACGACGTAGAG   528
                ·||                |||  ||·||||··||||·|
455_051.nt.2 68 CCGC---------------CAT-CTTAACCGGGTGTCC-----------    89

Ovr107     529 AGCTTTGTATCGAGGCTGCAGAAGTCGGCGGAGGCGGCCAGGGTGCTGGA   578
                |·||·|·|       ||||              |·||| ·||||||||·
455_051.nt.2 90 ACCTCTCT-------CTGC---------------CTGCC-TGGTGCTGGC   116

Ovr107     579 GCACCGGGAACGCGGCCGCAGGAGCCGGCGCCGGGCGGCT----GGGGAG   624
                ·|       ||||·||·|| ··||| |||||·|·|·|||    ···|||
455_051.nt.2 117 CC--------CGCGTCCCCA-TCGCC-GCGCCGTCTGCTCCCCTCAGAG   156

Ovr107     625 GGCTTGCTGACGCTGCGGGCCAAGCCGCCCTCGGAGGCCGAGTACACCGA   674
                ||||||||||||||||||||||||||||||||||||||||||||||||||
455_051.nt.2 157 GGCTTGCTGACGCTGCGGGCCAAGCCGCCCTCGGAGGCCGAGTACACCGA   206

Ovr107     675 CGTGCTGCAGAAGATCAAGTACGCCTTCAGCCTGCTGGCCCGGCTGCGCG   724
                ||||||||||||||||||||||||||||||||||||||||||||||||||
455_051.nt.2 207 CGTGCTGCAGAAGATCAAGTACGCCTTCAGCCTGCTGGCCCGGCTGCGCG   256
```

FIGURE 9 (continued)

```
Ovr107        725 GCAACATCGCCGACCCCTCCTCTCCGGAGCTGTTGCACTTCCTTTTCGGG  774
                  ||||||||||||||||||||||||||||||||||||||||||||||||||
455_051.nt.2  257 GCAACATCGCCGACCCCTCCTCTCCGGAGCTGTTGCACTTCCTTTTCGGG  306

Ovr107        775 CCTCTGCAGATGATTGTGAACACGTCGGGGGGGCCGGAGTTCGCGAGCAG  824
                  ||||||||||||||||||||||||||||||||||||||||||||||||||
455_051.nt.2  307 CCTCTGCAGATGATTGTGAACACGTCGGGGGGGCCGGAGTTCGCGAGCAG  356

Ovr107        825 TGTGCGGCGGCCGCATCTGACATCGGATGCCGTGGCGCTGCTGCGGGACA  874
                  ||||||||||||||||||||||||||||||||||||||||||||||||||
455_051.nt.2  357 TGTGCGGCGGCCGCATCTGACATCGGATGCCGTGGCGCTGCTGCGGGACA  406

Ovr107        875 ACGTCACTCCACGTGAAAACGAGCTCTGGACCTCGCTGGGGGACTCGTGG  924
                  ||||||||||||||||||||||||||||||||||||||||||||||||||
455_051.nt.2  407 ACGTCACTCCACGTGAAAACGAGCTCTGGACCTCGCTGGGGGACTCGTGG  456

Ovr107        925 ACCCGCCCCGGGCTGGAGCTGTCCCCGGAGGAGGGACCCCCATACAGACC  974
                  ||||||||||||||||||||||||||||||||||||||||||||||||||
455_051.nt.2  457 ACCCGCCCCGGGCTGGAGCTGTCCCCGGAGGAGGGACCCCCATACAGACC  506

Ovr107        975 CGAGTTCTTCAGCGGCTGGGAGCCGCCGGTCACTGACCCGCAGAGCCGCG 1024
                  ||||||||||||||||||||||||||||||||||||||||||||||||||
455_051.nt.2  507 CGAGTTCTTCAGCGGCTGGGAGCCGCCGGTCACTGACCCGCAGAGCCGCG  556

Ovr107       1025 CCTGGGAGGACCCAGTTGAGAAACAGCTACAGCACGAGCGGAGGCGCCGG 1074
                  ||||||||||||||||||||||||||||||||||||||||||||||||||
455_051.nt.2  557 CCTGGGAGGACCCAGTTGAGAAACAGCTACAGCACGAGCGGAGGCGCCGG  606

Ovr107       1075 CAGCAAAGCGCCCCCAGGTCGCTGTCAATGGTCACCGAGACTTGGAGCC  1124
                  ||||||||||||||||||||||||||||||||||||||||||||||||||
455_051.nt.2  607 CAGCAAAGCGCCCCCAGGTCGCTGTCAATGGTCACCGAGACTTGGAGCC   656

Ovr107       1125 AGAATCTGAGCCTCAGCTGGAGTCAGAGACAGCAGGAAAATGGGTCCTGT 1174
                  ||||||||||||||||||||||||||||||||||||||||||||||||||
455_051.nt.2  657 AGAATCTGAGCCTCAGCTGGAGTCAGAGACAGCAGGAAAATGGGTCCTGT  706

Ovr107       1175 GTAATTATGACTTCCAGGCCCGCAACAGCAGTGAGCTGTCGGTCAAGCAG 1224
                  ||||||||||||||||||||||||||||||||||||||||||||||||||
455_051.nt.2  707 GTAATTATGACTTCCAGGCCCGCAACAGCAGTGAGCTGTCGGTCAAGCAG  756

Ovr107       1225 CGGGACGTACTGGAGGTCCTGGATGACAGTCGTAAGTGGTGGAAGGTTCG 1274
                  ||||||||||||||||||||||||||||||||||||||||||||||||||
455_051.nt.2  757 CGGGACGTACTGGAGGTCCTGGATGACAGTCGTAAGTGGTGGAAGGTTCG  806

Ovr107       1275 GGACCCAGCGGGGCAGGAGGGATATGTGCCCTACAACATCCTGACACCCT 1324
                  ||||||||||||||||||||||||||||||||||||||||||||||||||
455_051.nt.2  807 GGACCCAGCGGGGCAGGAGGGATATGTGCCCTACAACATCCTGACACCCT  856

Ovr107       1325 ACCCCGGACCCCGGCTGCACCACAGCCAAAGCCCTGCCCGCAGCCTGAAC 1374
                  ||||||||||||||||||||||||||||||||||||||||||||||||||
455_051.nt.2  857 ACCCCGGACCCCGGCTGCACCACAGCCAAAGCCCTGCCCGCAGCCTGAAC  906

Ovr107       1375 AGCACTCCTCCTCCACCACCAGCCCCAGCCCCGGCCCCACCTCCAGCTCT 1424
                  ||||||||||||||||||||||||||||||||||||||||||||||||||
455_051.nt.2  907 AGCACTCCTCCTCCACCACCAGCCCCAGCCCCGGCCCCACCTCCAGCTCT  956

Ovr107       1425 GGCTCGGCCCCGCTGGGACAGGCCCCGCTGGGACAGCTGCGATAGCCTCA 1474
                  ||||||||||||||||||||||||||||||||||||||||||||||||||
455_051.nt.2  957 GGCTCGGCCCCGCTGGGACAGGCCCCGCTGGGACAGCTGCGATAGCCTCA 1006
```

FIGURE 9 (continued)

```
Ovr107         1475 ACGGCTTGGACCCCAGCGAGAAGGAGAAATTCTCCCAGATGCTCATCGTC 1524
                    ||||||||||||||||||||||||||||||||||||||||||||||||||
455_051.nt.  21007 ACGGCTTGGACCCCAGCGAGAAGGAGAAATTCTCCCAGATGCTCATCGTC 1056

Ovr107         1525 AACGAGGAACTGCAGGCGCGCCTGGCCCAGGGCCGCTCGGGACCGAGCCG 1574
                    ||||||||||||||||||||||||||||||||||||||||||||||||||
455_051.nt.2 1057 AACGAGGAACTGCAGGCGCGCCTGGCCCAGGGCCGCTCGGGACCGAGCCG 1106

Ovr107         1575 CGCAGTCCCAGGGCCCCGCGCCCCGGAACCGCAGCTCAGCCCGGGCTCGG 1624
                    ||||||||||||||||||||||||||||||||||||||||||||||||||
455_051.nt.2 1107 CGCAGTCCCAGGGCCCCGCGCCCCGGAACCGCAGCTCAGCCCGGGCTCGG 1156

Ovr107         1625 ACGCCTCCGAGGTCCGCGCCTGGCTGCAGGCCAAGGGCTTTAGCTCCGGG 1674
                    |||||||||||||||||||||||||||||||||||||||||||||||
455_051.nt.2 1157 ACGCCTCCGAGGTCCGCGCCTGGCTGCAGGCCAAGGGCTTTAGCTCCG-- 1204

Ovr107         1675 ACCGTGGACGCGCTGGGTGTGCTGACCGGGGCGCAGCTTTTCTCGCTGCA 1724

455_051.nt.2 1205 -------------------------------------------------- 1204

Ovr107         1725 GAGGGAGGAGCTGCGGGCGGTGAGCCCCGAGGAGGGGGCACGTGTGTACA 1774
                    ||·|||||||||||||||||||||||||||||||||||||||||||||||
455_051.nt.2 1205 GAAGGAGGAGCTGCGGGCGGTGAGCCCCGAGGAGGGGGCACGTGTGTACA 1254

Ovr107         1775 GCCAGGTCACCGTGCAGCGCTCGCTGCTGGAGGACAAAGAGAAAGTGTCA 1824
                    ||||||||||||||||||||||||||||||||||||||||||||||||||
455_051.nt.2 1255 GCCAGGTCACCGTGCAGCGCTCGCTGCTGGAGGACAAAGAGAAAGTGTCA 1304

Ovr107         1825 GAGCTGGAGGCAGTGATGGAGAAGCAAAAGAAGAAGGTGGAAGGCGAGGT 1874
                    ||||||||||||||||||||||||||||||||||||||||||||||||||
455_051.nt.2 1305 GAGCTGGAGGCAGTGATGGAGAAGCAAAAGAAGAAGGTGGAAGGCGAGGT 1354

Ovr107         1875 GGAAATGGAGGTCATTTGACCTGCCAGGCGCCCTTCGCAAAGAGTGACGA 1924
                    ||||||||||||||||||||||||||||||||||||||||||||||||||
455_051.nt.2 1355 GGAAATGGAGGTCATTTGACCTGCCAGGCGCCCTTCGCAAAGAGTGACGA 1404

Ovr107         1925 GGCCCCGTGGGAGAACGGACTCCTCAGACTCTCCCCAATAGCGGAAGTCG 1974
                    ||||||||||||||||||||||||||||||||||||||||||||||||||
455_051.nt.2 1405 GGCCCCGTGGGAGAACGGACTCCTCAGACTCTCCCCAATAGCGGAAGTCG 1454

Ovr107         1975 ATCTTCTGAAGGATGGCCAATCTGCTCCGGCCCTGGTCTTCCCCCATCCC 2024
                    ||||||||||||||||||||||||||||||||||||||||||||||||||
455_051.nt.2 1455 ATCTTCTGAAGGATGGCCAATCTGCTCCGGCCCTGGTCTTCCCCCATCCC 1504

Ovr107         2025 GGTGGACAGACTTAACGATCCTTGCTGCAGTCCCTCCGGAGAGGATCTGG 2074
                    ||||||||||||||||||||||||||||||||||||||||||||||||||
455_051.nt.2 1505 GGTGGACAGACTTAACGATCCTTGCTGCAGTCCCTCCGGAGAGGATCTGG 1554

Ovr107         2075 ACTGGCTGGGAGTGGGGAGGGCGTGGAGACAGTCTACGGAAAGCGCTAGC 2124
                    ||||||||||||||||||||||||||||||||||||||||||||||||||
455_051.nt.2 1555 ACTGGCTGGGAGTGGGGAGGGCGTGGAGACAGTCTACGGAAAGCGCTAGC 1604

Ovr107         2125 AGACCCCGAGAGGGTGCAGTGGAGCCCTGAGCATTGTAATATGCGGCCC 2174
                    ||||||||||||||||||||||||||||||||||||||||||||||||||
455_051.nt.2 1605 AGACCCCGAGAGGGTGCAGTGGAGCCCTGAGCATTGTAATATGCGGCCC 1654

Ovr107         2175 AGCCTATAAACAGCCTCCGTGCTTAGCAAAAAAAAAAAAAAAAAAAAA   2221
                    |||||||||||||||||||||||||||||·
455_051.nt.2 1655 AGCCTATAAACAGCCTCCGTGCTTAGCAG                     1683
```

FIGURE 10

```
Ovr107_aa       1 MNRTWPRRIWGSSQDEAELIREDIQGALHNYRSGRGERRAAALRATQEEL    50

455_051.aa.3    1                                                       0

Ovr107_aa      51 QRDRSPAAETPPLQRRPSVRAVISTVERGAGRGRPQAKPIPEAEEAQRPE   100

455_051.aa.3    1                                                       0

Ovr107_aa     101 PVGTSSNADSASPDLGPRGPDLAVLQAEREVDILNHVFDDVESFVSRLQK   150
                  .||  |.|..|...:.:|:                  ..:.|..
455_051.aa.3    1             MSP-LSPGSPLPPLARAD---------------LTAILTG    24

Ovr107_aa     151 SAEAARVLEHRERGRRSRRRAAGEGLLTLRAKPPSEAEYTDVLQKIKYAF   200
                  ....:..|....|..|..|....||||||||||||||||||||||||||
455_051.aa.3   25 CPPLSACLVLAPRPHRRARLLPSEGLLTLRAKPPSEAEYTDVLQKIKYAF    74

Ovr107_aa     201 SLLARLRGNIADPSSPELLHFLFGPLQMIVNTSGGPEFASSVRRPHLTSD   250
                  ||||||||||||||||||||||||||||||||||||||||||||||||||
455_051.aa.3   75 SLLARLRGNIADPSSPELLHFLFGPLQMIVNTSGGPEFASSVRRPHLTSD   124

Ovr107_aa     251 AVALLRDNVTPRENELWTSLGDSWTRPGLELSPEEGPPYRPEFFSGWEPP   300
                  ||||||||||||||||||||||||||||||||||||||||||||||||||
455_051.aa.3  125 AVALLRDNVTPRENELWTSLGDSWTRPGLELSPEEGPPYRPEFFSGWEPP   174

Ovr107_aa     301 VTDPQSRAWEDPVEKQLQHERRRRQQSAPQVAVNGHRDLEPESEPQLESE   350
                  ||||||||||||||||||||||||||||||||||||||||||||||||||
455_051.aa.3  175 VTDPQSRAWEDPVEKQLQHERRRRQQSAPQVAVNGHRDLEPESEPQLESE   224

Ovr107_aa     351 TAGKWVLCNYDFQARNSSELSVKQRDVLEVLDDSRKWWKVRDPAGQEGYV   400
                  ||||||||||||||||||||||||||||||||||||||||||||||||||
455_051.aa.3  225 TAGKWVLCNYDFQARNSSELSVKQRDVLEVLDDSRKWWKVRDPAGQEGYV   274

Ovr107_aa     401 PYNILTPYPGPRLHHSQSPARSLNSTPPPPPAPAPAPPPALARPRWDRPR   450
                  ||||||||||||||||||||||||||||||||||||||||||||||||||
455_051.aa.3  275 PYNILTPYPGPRLHHSQSPARSLNSTPPPPPAPAPAPPPALARPRWDRPR   324

Ovr107_aa     451 WDSCDSLNGLDPSEKEKFSQMLIVNEELQARLAQGRSGPSRAVPGPRAPE   500
                  ||||||||||||||||||||||||||||||||||||||||||||||||||
455_051.aa.3  325 WDSCDSLNGLDPSEKEKFSQMLIVNEELQARLAQGRSGPSRAVPGPRAPE   374

Ovr107_aa     501 PQLSPGSDASEVRAWLQAKGFSSGTVDALGVLTGAQLFSLQREELRAVSP   550
                  |||||||||||||||||||||||||||||||||||||||:||||||||
455_051.aa.3  375 PQLSPGSDASEVRAWLQAKGFSSGTVDALGVLTGAQLFSLQKEELRAVSP   424

Ovr107_aa     551 EEGARVYSQVTVQRSLLEDKEKVSELEAVMEKQKKKVEGEVEMEVI      596
                  |||||||||||||||||||||||||||||||||||||||||||||
455_051.aa.3  425 EEGARVYSQVTVQRSLLEDKEKVSELEAVMEKQKKKVEGEVEMEVI      470
```

FIGURE 11

```
Ovr107_aa      1 MNRTWPRRIWGSSQDEAELIREDIQGALHNYRSGRGERRAAALRATQEEL  50

455_051.aa.2   1                                                      0

Ovr107_aa     51 QRDRSPAAETPPLQRRPSVRAVISTVERGAGRGRPQAKPIPEAEEAQRPE 100

455_051.aa.2   1                                                      0

Ovr107_aa    101 PVGTSSNADSASPDLGPRGPDLAVLQAEREVDILNHVFDDVESFVSRLQK  50
                 :....||  |.|..|...:.:|:              ...:.|..
455_051.aa.2   1 DLFQMSP-LSPGSPLPPLARAD---------------LTAILTG        28

Ovr107_aa    151 SAEAARVLEHRERGRRSRRRAAGEGLLTLRAKPPSEAEYTDVLQKIKYAF 200
                 ....:...|....|..|..|....||||||||||||||||||||||||||
455_051.aa.2  29 CPPLSACLVLAPRPHRRARLLPSEGLLTLRAKPPSEAEYTDVLQKIKYAF  78

Ovr107_aa    201 SLLARLRGNIADPSSPELLHFLFGPLQMIVNTSGGPEFASSVRRPHLTSD 250
                 ||||||||||||||||||||||||||||||||||||||||||||||||||
455_051.aa.2  79 SLLARLRGNIADPSSPELLHFLFGPLQMIVNTSGGPEFASSVRRPHLTSD 128

Ovr107_aa    251 AVALLRDNVTPRENELWTSLGDSWTRPGLELSPEEGPPYRPEFFSGWEPP 300
                 ||||||||||||||||||||||||||||||||||||||||||||||||||
455_051.aa.2 129 AVALLRDNVTPRENELWTSLGDSWTRPGLELSPEEGPPYRPEFFSGWEPP 178

Ovr107_aa    301 VTDPQSRAWEDPVEKQLQHERRRRQQSAPQVAVNGHRDLEPESEPQLESE 350
                 ||||||||||||||||||||||||||||||||||||||||||||||||||
455_051.aa.2 179 VTDPQSRAWEDPVEKQLQHERRRRQQSAPQVAVNGHRDLEPESEPQLESE 228

Ovr107_aa    351 TAGKWVLCNYDFQARNSSELSVKQRDVLEVLDDSRKWWKVRDPAGQEGYV 400
                 ||||||||||||||||||||||||||||||||||||||||||||||||||
455_051.aa.2 229 TAGKWVLCNYDFQARNSSELSVKQRDVLEVLDDSRKWWKVRDPAGQEGYV 278

Ovr107_aa    401 PYNILTPYPGPRLHHSQSPARSLNSTPPPPPAPAPAPPPALARPRWDRPR 450
                 ||||||||||||||||||||||||||||||||||||||||||||||||||
455_051.aa.2 279 PYNILTPYPGPRLHHSQSPARSLNSTPPPPPAPAPAPPPALARPRWDRPR 328

Ovr107_aa    451 WDSCDSLNGLDPSEKEKFSQMLIVNEELQARLAQGRSGPSRAVPGPRAPE 500
                 ||||||||||||||||||||||||||||||||||||||||||||||||||
455_051.aa.2 329 WDSCDSLNGLDPSEKEKFSQMLIVNEELQARLAQGRSGPSRAVPGPRAPE 378

Ovr107_aa    501 PQLSPGSDASEVRAWLQAKGFSSGTVDALGVLTGAQLFSLQREELRAVSP 550
                 ||||||||||||||||||||||||||||......
455_051.aa.2 379 PQLSPGSDASEVRAWLQAKGFSSGRRSCGR                     408

Ovr107_aa    551 EEGARVYSQVTVQRSLLEDKEKVSELEAVMEKQKKKVEGEVEMEVI     596

```
Ovr107         1 AGAGCAAGGAAGGGCAGGGGACCTGGGAAGGAAGTTCTGGAAGGCAGTGG  50

455_051.nt.3   1                                                          0

Ovr107        51 GGTTTGAGATTGGACCCAGGGTCAAGATAGAACATGAAGGTGGGATGAGG 100

455_051.nt.3   1                                                          0

Ovr107       101 ACATGAACAGAACATGGCCAAGAAGGATCTGGGGGAGCAGCCAGGACGAG 150

455_051.nt.3   1                                                          0

Ovr107       151 GCGGAGCTGATCCGAGAGGACATCCAGGGGGCTCTGCACAATTACCGCTC 200

455_051.nt.3   1                                                          0

Ovr107       201 GGGCCGCGGGGAGCGCAGGGCGGCGGCGCTCAGGGCCACGCAGGAGGAGT 250

455_051.nt.3   1                                                          0

Ovr107       251 TGCAGCGCGACCGCTCGCCCGCCGCTGAGACCCCGCCCCTGCAGCGCCGC 300

455_051.nt.3   1                                                          0

Ovr107       301 CCGTCAGTCCGCGCAGTGATCAGCACCGTAGAGCGGGGCGCGGGCCGCGG 350

455_051.nt.3   1                                                          0

Ovr107       351 ACGACCCCAGGCGAAGCCCATTCCCGAGGCAGAGGAGGCGCAGAGGCCTG 400

455_051.nt.3   1                                                          0

Ovr107       401 AGCCGGTGGGGACCTCGAGCAA-------CGCTGACTC----GGC-CTCC 438
                           ||·|||···|||       ||||    |||    ||| ||||
455_051.nt.3   1          GATCTCTTCCAAATGTCCCCGCT--CTCCCCAGGCTCTCC  38

Ovr107       439 CCGGACCTGGGTCC---------CCGGGGTCCTGACCTGGCGGTTCTGCA 479
                 ||         |||         ||·|||  |||||||          ||
455_051.nt.3  39 CC---------TCCCGCCACTTGCCAGGG--CTGACCT----------CA  67

Ovr107       480 -GGCGGAGCGGGAAGTGGACATCCTGAACCACGTGTTCGACGACGTAGAG 528
                  ·||               ||| ||·||||··||||·|
455_051.nt.3  68 CCGC---------------CAT-CTTAACCGGGTGTCC------------  89

Ovr107       529 AGCTTTGTATCGAGGCTGCAGAAGTCGGCGGAGGCGGCCAGGGTGCTGGA 578
                 |·||·|·|    ||||               |·|||  ·||||||||·
455_051.nt.3  90 ACCTCTCT-------CTGC--------------CTGCC-TGGTGCTGGC 116

Ovr107       579 GCACCGGGAACGCGGCCGCAGGAGCCGGCGCCGGGCGGCT----GGGGAG 624
                 ·|        ||||·||·||  ·|||  |||||·|·|·|||   ···|||
455_051.nt.3 117 CC--------CGCGTCCCCA-TCGCC-GCGCCGTCTGCTCCCCTCAGAG 156

Ovr107       625 GGCTTGCTGACGCTGCGGGCCAAGCCGCCCTCGGAGGCCGAGTACACCGA 674
                 ||||||||||||||||||||||||||||||||||||||||||||||||||
455_051.nt.3 157 GGCTTGCTGACGCTGCGGGCCAAGCCGCCCTCGGAGGCCGAGTACACCGA 206

Ovr107       675 CGTGCTGCAGAAGATCAAGTACGCCTTCAGCCTGCTGGCCCGGCTGCGCG 724
                 ||||||||||||||||||||||||||||||||||||||||||||||||||
455_051.nt.3 207 CGTGCTGCAGAAGATCAAGTACGCCTTCAGCCTGCTGGCCCGGCTGCGCG 256
```

FIGURE 12 (continued)

```
Ovr107        725 GCAACATCGCCGACCCCTCCTCTCCGGAGCTGTTGCACTTCCTTTTCGGG  774
                  ||||||||||||||||||||||||||||||||||||||||||||||||||
455_051.nt.3  257 GCAACATCGCCGACCCCTCCTCTCCGGAGCTGTTGCACTTCCTTTTCGGG  306

Ovr107        775 CCTCTGCAGATGATTGTGAACACGTCGGGGGGGCCGGAGTTCGCGAGCAG  824
                  ||||||||||||||||||||||||||||||||||||||||||||||||||
455_051.nt.3  307 CCTCTGCAGATGATTGTGAACACGTCGGGGGGGCCGGAGTTCGCGAGCAG  356

Ovr107        825 TGTGCGGCGGCCGCATCTGACATCGGATGCCGTGGCGCTGCTGCGGGACA  874
                  ||||||||||||||||||||||||||||||||||||||||||||||||||
455_051.nt.3  357 TGTGCGGCGGCCGCATCTGACATCGGATGCCGTGGCGCTGCTGCGGGACA  406

Ovr107        875 ACGTCACTCCACGTGAAAACGAGCTCTGGACCTCGCTGGGGGACTCGTGG  924
                  ||||||||||||||||||||||||||||||||||||||||||||||||||
455_051.nt.3  407 ACGTCACTCCACGTGAAAACGAGCTCTGGACCTCGCTGGGGGACTCGTGG  456

Ovr107        925 ACCCGCCCCGGGCTGGAGCTGTCCCCGGAGGAGGGACCCCCATACAGACC  974
                  ||||||||||||||||||||||||||||||||||||||||||||||||||
455_051.nt.3  457 ACCCGCCCCGGGCTGGAGCTGTCCCCGGAGGAGGGACCCCCATACAGACC  506

Ovr107        975 CGAGTTCTTCAGCGGCTGGGAGCCGCCGGTCACTGACCCGCAGAGCCGCG  024
                  ||||||||||||||||||||||||||||||||||||||||||||||||||
455_051.nt.3  507 CGAGTTCTTCAGCGGCTGGGAGCCGCCGGTCACTGACCCGCAGAGCCGCG  556

Ovr107       1025 CCTGGGAGGACCCAGTTGAGAAACAGCTACAGCACGAGCGGAGGCGCCGG 1074
                  ||||||||||||||||||||||||||||||||||||||||||||||||||
455_051.nt.3  557 CCTGGGAGGACCCAGTTGAGAAACAGCTACAGCACGAGCGGAGGCGCCGG  606

Ovr107       1075 CAGCAAAGCGCCCCCAGGTCGCTGTCAATGGTCACCGAGACTTGGAGCC 1124
                  ||||||||||||||||||||||||||||||||||||||||||||||||||
455_051.nt.3  607 CAGCAAAGCGCCCCCCAGGTCGCTGTCAATGGTCACCGAGACTTGGAGCC  656

Ovr107       1125 AGAATCTGAGCCTCAGCTGGAGTCAGAGACAGCAGGAAAATGGGTCCTGT 1174
                  ||||||||||||||||||||||||||||||||||||||||||||||||||
455_051.nt.3  657 AGAATCTGAGCCTCAGCTGGAGTCAGAGACAGCAGGAAAATGGGTCCTGT  706

Ovr107       1175 GTAATTATGACTTCCAGGCCCGCAACAGCAGTGAGCTGTCGGTCAAGCAG 1224
                  ||||||||||||||||||||||||||||||||||||||||||||||||||
455_051.nt.3  707 GTAATTATGACTTCCAGGCCCGCAACAGCAGTGAGCTGTCGGTCAAGCAG  756

Ovr107       1225 CGGGACGTACTGGAGGTCCTGGATGACAGTCGTAAGTGGTGGAAGGTTCG 1274
                  ||||||||||||||||||||||||||||||||||||||||||||||||||
455_051.nt.3  757 CGGGACGTACTGGAGGTCCTGGATGACAGTCGTAAGTGGTGGAAGGTTCG  806

Ovr107       1275 GGACCCAGCGGGGCAGGAGGGATATGTGCCCTACAACATCCTGACACCCT 1324
                  ||||||||||||||||||||||||||||||||||||||||||||||||||
455_051.nt.3  807 GGACCCAGCGGGGCAGGAGGGATATGTGCCCTACAACATCCTGACACCCT  856

Ovr107       1325 ACCCCGGACCCCGGCTGCACCACAGCCAAAGCCCTGCCCGCAGCCTGAAC  374
                  ||||||||||||||||||||||||||||||||||||||||||||||||||
455_051.nt.3  857 ACCCCGGACCCCGGCTGCACCACAGCCAAAGCCCTGCCCGCAGCCTGAAC  906

Ovr107       1375 AGCACTCCTCCTCCACCACCAGCCCCAGCCCCGGCCCCACCTCCAGCTCT 1424
                  ||||||||||||||||||||||||||||||||||||||||||||||||||
455_051.nt.3  907 AGCACTCCTCCTCCACCACCAGCCCCAGCCCCGGCCCCACCTCCAGCTCT  956

Ovr107       1425 GGCTCGGCCCCGCTGGGACAGGCCCCGCTGGGACAGCTGCGATAGCCTCA 1474
                  ||||||||||||||||||||||||||||||||||||||||||||||||||
455_051.nt.3  957 GGCTCGGCCCCGCTGGGACAGGCCCCGCTGGGACAGCTGCGATAGCCTCA 1006
```

FIGURE 12 (continued)

```
Ovr107         1475 ACGGCTTGGACCCCAGCGAGAAGGAGAAATTCTCCCAGATGCTCATCGTC 1524
                    ||||||||||||||||||||||||||||||||||||||||||||||||||
455_051.nt.3   1007 ACGGCTTGGACCCCAGCGAGAAGGAGAAATTCTCCCAGATGCTCATCGTC 1056

Ovr107         1525 AACGAGGAACTGCAGGCGCGCCTGGCCCAGGGCCGCTCGGGACCGAGCCG 1574
                    ||||||||||||||||||||||||||||||||||||||||||||||||||
455_051.nt.3   1057 AACGAGGAACTGCAGGCGCGCCTGGCCCAGGGCCGCTCGGGACCGAGCCG 1106

Ovr107         1575 CGCAGTCCCAGGGCCCCGCGCCCCGGAACCGCAGCTCAGCCCGGGCTCGG 1624
                    ||||||||||||||||||||||||||||||||||||||||||||||||||
455_051.nt.3   1107 CGCAGTCCCAGGGCCCCGCGCCCCGGAACCGCAGCTCAGCCCGGGCTCGG 1156

Ovr107         1625 ACGCCTCCGAGGTCCGCGCCTGGCTGCAGGCCAAGGGCTTTAGCTCCGGG 1674
                    ||||||||||||||||||||||||||||||||||||||||||||||||||
455_051.nt.3   1157 ACGCCTCCGAGGTCCGCGCCTGGCTGCAGGCCAAGGGCTTTAGCTCCGGG 1206

Ovr107         1675 ACCGTGGACGCGCTGGGTGTGCTGACCGGGGCGCAGCTTTTCTCGCTGCA 1724
                    ||||||||||||||||||||||||||||||||||||||||||||||||||
455_051.nt.3   1207 ACCGTGGACGCGCTGGGTGTGCTGACCGGGGCGCAGCTTTTCTCGCTGCA 1256

Ovr107         1725 GAGGGAGGAGCTGCGGGCGGTGAGCCCCGAGGAGGGGGCACGTGTGTACA 1774
                    ||·|||||||||||||||||||||||||||||||||||||||||||||||
455_051.nt.3   1257 GAAGGAGGAGCTGCGGGCGGTGAGCCCCGAGGAGGGGGCACGTGTGTACA 1306

Ovr107         1775 GCCAGGTCACCGTGCAGCGCTCGCTGCTGGAGGACAAAGAGAAAGTGTCA 1824
                    ||||||||||||||||||||||||||||||||||||||||||||||||||
455_051.nt.3   1307 GCCAGGTCACCGTGCAGCGCTCGCTGCTGGAGGACAAAGAGAAAGTGTCA 1356

Ovr107         1825 GAGCTGGAGGCAGTGATGGAGAAGCAAAAGAAGAAGGTGGAAGGCGAGGT 1874
                    ||||||||||||||||||||||||||||||||||||||||||||||||||
455_051.nt.3   1357 GAGCTGGAGGCAGTGATGGAGAAGCAAAAGAAGAAGGTGGAAGGCGAGGT 1406

Ovr107         1875 GGAAATGGAGGTCATTTGACCTGCCAGGCGCCCTTCGCAAAGAGTGACGA 1924
                    ||||||||||||||||||||||||||||||||||||||||||||||||||
455_051.nt.3   1407 GGAAATGGAGGTCATTTGACCTGCCAGGCGCCCTTCGCAAAGAGTGACGA 1456

Ovr107         1925 GGCCCCGTGGGAGAACGGACTCCTCAGACTCTCCCCAATAGCGGAAGTCG 1974
                    ||||||||||||||||||||||||||||||||||||||||||||||||||
455_051.nt.3   1457 GGCCCCGTGGGAGAACGGACTCCTCAGACTCTCCCCAATAGCGGAAGTCG 1506

Ovr107         1975 ATCTTCTGAAGGATGGCCAATCTGCTCCGGCCCTGGTCTTCCCCCATCCC 2024
                    ||||||||||||||||||||||||||||||||||||||||||||||||||
455_051.nt.3   1507 ATCTTCTGAAGGATGGCCAATCTGCTCCGGCCCTGGTCTTCCCCCATCCC 1556

Ovr107         2025 GGTGGACAGACTTAACGATCCTTGCTGCAGTCCCTCCGGAGAGGATCTGG 2074
                    ||||||||||||||||||||||||||||||||||||||||||||||||||
455_051.nt.3   1557 GGTGGACAGACTTAACGATCCTTGCTGCAGTCCCTCCGGAGAGGATCTGG 1606

Ovr107         2075 ACTGGCTGGGAGTGGGGAGGGCGTGGAGACAGTCTACGGAAAGCGCTAGC 2124
                    ||||||||||||||||||||||||||||||||||||||||||||||||||
455_051.nt.3   1607 ACTGGCTGGGAGTGGGGAGGGCGTGGAGACAGTCTACGGAAAGCGCTAGC 1656

Ovr107         2125 AGACCCCGAGAGGGTGCAGTGGAGCCCTGAGCATTGTAATATGCGGCCC 2174
                    ||||||||||||||||||||||||||||||||||||||||||||||||||
455_051.nt.3   1657 AGACCCCGAGAGGGTGCAGTGGAGCCCTGAGCATTGTAATATGCGGCCC 1706

Ovr107         2175 AGCCTATAAACAGCCTCCGTGCTTAGCAAAAAAAAAAAAAAAAAAAAAA  2221
                    |||||||||||||||||||||||||||||·
455_051.nt.3   1707 AGCCTATAAACAGCCTCCGTGCTTAGCAG                    1735
```

FIGURE 13

```
Ovr107        1 AGAGCAAGGAAGGGCAGGGGACCTGGGAAGGAAGTTCTGGAAGGCAGTGG   50

455_051.nt.4  1                                                        0

Ovr107       51 GGTTTGAGATTGGACCCAGGGTCAAGATAGAACATGAAGGTGGGATGAGG  100

455_051.nt.4  1                                                        0

Ovr107      101 ACATGAACAGAACATGGCCAAGAAGGATCTGGGGGAGCAGCCAGGACGAG  150

455_051.nt.4  1                                                        0

Ovr107      151 GCGGAGCTGATCCGAGAGGACATCCAGGGGGCTCTGCACAATTACCGCTC  200

455_051.nt.4  1                                                        0

Ovr107      201 GGGCCGCGGGGAGCGCAGGGCGGCGGCGCTCAGGGCCACGCAGGAGGAGT  250

455_051.nt.4  1                                                        0

Ovr107      251 TGCAGCGCGACCGCTCGCCCGCCGCTGAGACCCCGCCCCTGCAGCGCCGC  300

455_051.nt.4  1                                                        0

Ovr107      301 CCGTCAGTCCGCGCAGTGATCAGCACCGTAGAGCGGGGCGCGGGCCGCGG  350

455_051.nt.4  1                                                        0

Ovr107      351 ACGACCCCAGGCGAAGCCCATTCCCGAGGCAGAGGAGGCGCAGAGGCCTG  400

455_051.nt.4  1                                                        0

Ovr107      401 AGCCGGTGGGGACCTCGAGCAA-------CGCTGACTC----GGC-CTCC  438
                            ||·|||···|||        ||||   |||     ||| ||||
455_051.nt.4  1             GATCTCTTCCAAATGTCCCCGCT--CTCCCCAGGCTCTCC   38

Ovr107      439 CCGGACCTGGGTCC---------CCGGGGTCCTGACCTGGCGGTTCTGCA   79
                    ||          |||         ||·|||  |||||||          ||
455_051.nt.4 39 CC---------TCCCGCCACTTGCCAGGG--CTGACCT----------CA   67

Ovr107      480 -GGCGGAGCGGGAAGTGGACATCCTGAACCACGTGTTCGACGACGTAGAG   28
                  ·||                 ||| ||·||||··||||·|
455_051.nt.4 68 CCGC--------------CAT-CTTAACCGGGTGTCC------------   89

Ovr107      529 AGCTTTGTATCGAGGCTGCAGAAGTCGGCGGAGGCGGCCAGGGTGCTGGA   78
                 |·||·|·|      ||||               |·|||  ·||||||||·
455_051.nt.4 90 ACCTCTCT-------CTGC---------------CTGCC-TGGTGCTGGC   16

Ovr107      579 GCACCGGGAACGCGGCCGCAGGAGCCGGCGCCGGGCGGCT----GGGGAG   24
                 ·|        ||||·||·|| ··||| |||||·|·|·|||    ···|||
455_051.nt.4117 CC--------CGCGTCCCCA-TCGCC-GCGCCCGTCTGCTCCCCTCAGAG  156

Ovr107      625 GGCTTGCTGACGCTGCGGGCCAAGCCGCCCTCGGAGGCCGAGTACACCGA  674
                 ||||||||||||||||||||||||||||||||||||||||||||||||||
455_051.nt.4157 GGCTTGCTGACGCTGCGGGCCAAGCCGCCCTCGGAGGCCGAGTACACCGA  206

Ovr107      675 CGTGCTGCAGAAGATCAAGTACGCCTTCAGCCTGCTGGCCCGGCTGCGCG  724
                 ||||||||||||||||||||||||||||||||||||||||||||||||||
455_051.nt.4207 CGTGCTGCAGAAGATCAAGTACGCCTTCAGCCTGCTGGCCCGGCTGCGCG  256
```

FIGURE 13 (continued)

```
Ovr107         725 GCAACATCGCCGACCCCTCCTCTCCGGAGCTGTTGCACTTCCTTTTCGGG  774
                   ||||||||||||||||||||||||||||||||||||||||||||||||||
455_051.nt.4   257 GCAACATCGCCGACCCCTCCTCTCCGGAGCTGTTGCACTTCCTTTTCGGG  306

Ovr107         775 CCTCTGCAGATGATTGTGAACACGTCGGGGGGGCCGGAGTTCGCGAGCA   824
                   ||||||||||||||||||||||||||||||||||||||||||||||||||
455_051.nt.4   307 CCTCTGCAGATGATTGTGAACACGTCGGGGGGGCCGGAGTTCGCGAGCAG  356

Ovr107         825 TGTGCGGCGGCCGCATCTGACATCGGATGCCGTGGCGCTGCTGCGGGACA  874
                   ||||||||||||||||||||||||||||||||||||||||||||||||||
455_051.nt.4   357 TGTGCGGCGGCCGCATCTGACATCGGATGCCGTGGCGCTGCTGCGGGACA  406

Ovr107         875 ACGTCACTCCACGTGAAAACGAGCTCTGGACCTCGCTGGGGGACTCGTGG  924
                   ||||||||||||||||||||||||||||||||||||||||||||||||||
455_051.nt.4   407 ACGTCACTCCACGTGAAAACGAGCTCTGGACCTCGCTGGGGGACTCGTGG  456

Ovr107         925 ACCCGCCCCGGGCTGGAGCTGTCCCCGGAGGAGGGACCCCCATACAGACC  974
                   ||||||||||||||||||||||||||||||||||||||||||||||||||
455_051.nt.4   457 ACCCGCCCCGGGCTGGAGCTGTCCCCGGAGGAGGGACCCCCATACAGACC  506

Ovr107         975 CGAGTTCTTCAGCGGCTGGGAGCCGCCGGTCACTGACCCGCAGAGCCGCG 1024
                   ||||||||||||||||||||||||||||||||||||||||||||||||||
455_051.nt.4   507 CGAGTTCTTCAGCGGCTGGGAGCCGCCGGTCACTGACCCGCAGAGCCGCG  556

Ovr107        1025 CCTGGGAGGACCCAGTTGAGAAACAGCTACAGCACGAGCGGAGGCGCCGG 1074
                   ||||||||||||||||||||||||||||||||||||||||||||||||||
455_051.nt.4   557 CCTGGGAGGACCCAGTTGAGAAACAGCTACAGCACGAGCGGAGGCGCCGG  606

Ovr107        1075 CAGCAAAGCGCCCCCAGGTCGCTGTCAATGGTCACCGAGACTTGGAGCC  1124
                   ||||||||||||||||||||||||||||||||||||||||||||||||||
455_051.nt.4   607 CAGCAAAGCGCCCCCCAGGTCGCTGTCAATGGTCACCGAGACTTGGAGCC  656

Ovr107        1125 AGAATCTGAGCCTCAGCTGGAGTCAGAGACAGCAGGAAAATGGGTCCTGT 1174
                   ||||||||||||||||||||||||||||||||||||||||||||||||||
455_051.nt.4   657 AGAATCTGAGCCTCAGCTGGAGTCAGAGACAGCAGGAAAATGGGTCCTGT  706

Ovr107        1175 GTAATTATGACTTCCAGGCCCGCAACAGCAGTGAGCTGTCGGTCAAGCAG  224
                   ||||||||||||||||||||||||||||||||||||||||||||||||||
455_051.nt.4   707 GTAATTATGACTTCCAGGCCCGCAACAGCAGTGAGCTGTCGGTCAAGCAG  756

Ovr107        1225 CGGGACGTACTGGAGGTCCTGGATGACAGTCGTAAGTGGTGGAAGGTTCG 1274
                   ||||||||||||||||||||||||||||||||||||||||||||||||||
455_051.nt.4   757 CGGGACGTACTGGAGGTCCTGGATGACAGTCGTAAGTGGTGGAAGGTTCG  806

Ovr107        1275 GGACCCAGCGGGGCAGGAGGGATATGTGCCCTACAACATCCTGACACCCT 1324
                   ||||||||||||||||||||||||||||||||||||||||||||||||||
455_051.nt.4   807 GGACCCAGCGGGGCAGGAGGGATATGTGCCCTACAACATCCTGACACCCT  856

Ovr107        1325 ACCCCGGACCCCGGCTGCACCACAGCCAAAGCCCTGCCCGCAGCCTGAAC 1374
                   ||||||||||||||||||||||||||||||||||||||||||||||||||
455_051.nt.4   857 ACCCCGGACCCCGGCTGCACCACAGCCAAAGCCCTGCCCGCAGCCTGAAC  906

Ovr107        1375 AGCACTCCTCCTCCACCACCAGCCCCAGCCCCGGCCCCACCTCCAGCTCT 1424
                   ||||||||||||||||||||||||||||||||||||||||||||||||||
455_051.nt.4   907 AGCACTCCTCCTCCACCACCAGCCCCAGCCCCGGCCCCACCTCCAGCTCT  956

Ovr107        1425 GGCTCGGCCCCGCTGGGACAGGCCCCGCTGGGACAGCTGCGATAGCCTCA 1474
                   ||||||||||||||||||||||||||||||||||||||||||||||||||
455_051.nt.4   957 GGCTCGGCCCCGCTGGGACAGGCCCCGCTGGGACAGCTGCGATAGCCTCA 1006
```

FIGURE 13 (continued)

```
Ovr107         1475 ACGGCTTGGACCCCAGCGAGAAGGAGAAATTCTCCCAGATGCTCATCGTC 1524
                    ||||||||||||||||||||||||||||||||||||||||||||||||||
455_051.nt.4   1007 ACGGCTTGGACCCCAGCGAGAAGGAGAAATTCTCCCAGATGCTCATCGTC 1056

Ovr107         1525 AACGAGGAACTGCAGGCGCGCCTGGCCCAGGGCCGCTCGGGACCGAGCCG 1574
                    ||||||||||||||||||||||||||||||||||||||||||||||||||
455_051.nt.4   1057 AACGAGGAACTGCAGGCGCGCCTGGCCCAGGGCCGCTCGGGACCGAGCCG 1106

Ovr107         1575 CGCAGTCCCAGGGCCCCGCGCCCCGGAACCGCAGCTCAGCCCGGGCTCGG 1624
                    ||||||||||||||||||||||||||||||||||||||||||||||||||
455_051.nt.4   1107 CGCAGTCCCAGGGCCCCGCGCCCCGGAACCGCAGCTCAGCCCGGGCTCGG 1156

Ovr107         1625 ACGCCTCCGAGGTCCGCGCCTGGCTGCAGGCCAAGGGCTTTAGCTCCGGG 1674
                    | ||||||||||||||||||||||||||||||||||||||||||||||||
455_051.nt.4   1157 ACGCCTCCGAGGTCCGCGCCTGGCTGCAGGCCAAGGGCTTTAGCTCCGGG 1206

Ovr107         1675 ACCGTGGACGCGCTGGGTGTGCTGACCGGGGCGCAGCTTTTCTCGCTGCA 1724
                    ||||||||||||||||||||||||||||||||||||||||||||||||||
455_051.nt.4   1207 ACCGTGGACGCGCTGGGTGTGCTGACCGGGGCGCAGCTTTTCTCGCTGCA 1256

Ovr107         1725 GAGGGAGGAGCTGCGGGCGGTGAGCCCCGAGGAGGGGCACGTGTGTACA 1774
                    ||-|||||||||||||||||||||||||||||||||||||||||||||||
455_051.nt.4   1257 GAAGGAGGAGCTGCGGGCGGTGAGCCCCGAGGAGGGGCACGTGTGTACA 1306

Ovr107         1775 GCCAGGTCACCGTGCAGCGCTCGCTGCTGGAGGACAAAGAGAAAGTGTCA 1824
                    ||||||||||||||||||||||||||||||||||||||||||||||||||
455_051.nt.4   1307 GCCAGGTCACCGTGCAGCGCTCGCTGCTGGAGGACAAAGAGAAAGTGTCA 1356

Ovr107         1825 GAGCTGGAGGCAGTGATGGAGAAGCAAAAGAAGAAGGTGGAAGGCGAGGT 1874
                    ||||||||||||||||||||||||||||||||||||||||||||||||||
455_051.nt.4   1357 GAGCTGGAGGCAGTGATGGAGAAGCAAAAGAAGAAGGTGGAAGGCGAGGT 1406

Ovr107         1875 GGAAATGGAGGTCATTTGACCTGCCAGGCGCCCTTCGCAAAGAGTGACGA 1924
                    ||||||||||||||||||||||||||||||||||||||||||||||||||
455_051.nt.4   1407 GGAAATGGAGGTCATTTGACCTGCCAGGCGCCCTTCGCAAAGAGTGACGA 1456

Ovr107         1925 GGCCCCGTGGGAGAACGGACTCCTCAGACTCTCCCCAATAGCGGAAGTCG 1974
                    ||||||||||||||||||||||||||||||||||||||||||||||||||
455_051.nt.4   1457 GGCCCCGTGGGAGAACGGACTCCTCAGACTCTCCCCAATAGCGGAAGTCG 1506

Ovr107         1975 ATCTTCTGAAGGATGGCCAATCTGCTCCGGCCCTGGTCTTCCCCCATCCC 2024
                    ||||||||||||||||||||||||||||||||||||||||||||||||||
455_051.nt.4   1507 ATCTTCTGAAGGATGGCCAATCTGCTCCGGCCCTGGTCTTCCCCCATCCC 1556

Ovr107         2025 GGTGGACAGACTTAACGATCCTTGCTGCAGTCCCTCCGGAGAGGATCTGG 2074
                    ||||||||||||||||||||||||||||||||||||||||||||||||||
455_051.nt.4   1557 GGTGGACAGACTTAACGATCCTTGCTGCAGTCCCTCCGGAGAGGATCTGG 1606

Ovr107         2075 ACTGGCTGGGAGTGGGGAGGGCGTGGAGACAGTCTACGGAAAGCGCTAGC 2124
                    ||||||||||||||||||||||||||||||||||||||||||||||||||
455_051.nt.4   1607 ACTGGCTGGGAGTGGGGAGGGCGTGGAGACAGTCTACGGAAAGCGCTAGC 1656

Ovr107         2125 AGACCCCGAGAGGGTGCAGTGGAGCCCTGAGCATTGTAATATGCGGCCC 2174
                    ||||||||||||||||||||||||||||||||||||||||||||||||||
455_051.nt.4   1657 AGACCCCGAGAGGGTGCAGTGGAGCCCTGAGCATTGTAATATGCGGCCC 1706

Ovr107         2175 AGCCTATAAACAGCCTCCGTGCTTAGCAAAAAAAAAAAAAAAAAAAAA    2221
                    ||||||||||||||||||||||||||||||-|||||||||||||||||||
455_051.nt.4   1707 AGCCTATAAACAGCCTCCGTGCTTAGCAGAAAAAAAAAAAAAAAAAAAAA 1756
```

FIGURE 13 (continued)

```
Ovr107         2222                                                     2221

455_051.nt.4 1757 AAAAAAAAAAAAAAAAAAAAAAAAAAAAAAAAAAACATACAAAAAATAAAAGA 1806

Ovr107         2222                                                     2221

455_051.nt.4 1807 ATAGTCAACAAACAAAATAAGAAACTATAGATAATATAAAAATGAAAATA 1856

Ovr107         2222                                                     2221

455_051.nt.4 1857 AAAAAGAGATGGGGTGGGGCCCTTGTCTTTACTCTCTCCCTCTGGAGTGG 1906

Ovr107         2222                                                     2221

455_051.nt.4 1907 GCACACTATATTATTTCGCCCTCCCCCTCTTTTTTTGTATGAGAGGGCTC 1956

Ovr107         2222                                                     2221

455_051.nt.4 1957 TTTTA                                                  1961
```

FIGURE 14

```
Ovr107         1 AGAGCAAGGAAGGGCAGGGGACCTGGGAAGGAAGTTCTGGAAGGCAGTGG    50

455_051.nt.5   1                                                         0

Ovr107        51 GGTTTGAGATTGGACCCAGGGTCAAGATAGAACATGAAGGTGGGATGAGG   100

455_051.nt.5   1                                                         0

Ovr107       101 ACATGAACAGAACATGGCCAAGAAGGATCTGGGGGAGCAGCCAGGACGAG   150

455_051.nt.5   1                                                         0

Ovr107       151 GCGGAGCTGATCCGAGAGGACATCCAGGGGGCTCTGCACAATTACCGCTC   200

455_051.nt.5   1                                                         0

Ovr107       201 GGGCCGCGGGGAGCGCAGGGCGGCGGCGCTCAGGGCCACGCAGGAGGAGT   250

455_051.nt.5   1                                                         0

Ovr107       251 TGCAGCGCGACCGCTCGCCCGCCGCTGAGACCCCGCCCCTGCAGCGCCGC   300

455_051.nt.5   1                                                         0

Ovr107       301 CCGTCAGTCCGCGCAGTGATCAGCACCGTAGAGCGGGGCGCGGGCCGCGG    50

455_051.nt.5   1                                                         0

Ovr107       351 ACGACCCCAGGCGAAGCCCATTCCCGAGGCAGAGGAGGCGCAGAGGCCTG   400

455_051.nt.5   1                                                         0

Ovr107       401 AGCCGGTGGGGACCTCGAGCAA-------CGCTGACTC----GGC-CTCC   438
                   ||·|||···|||        ||||    |||       ||| ||||
455_051.nt.5   1                 GATCTCTTCCAAATGTCCCCGCT--CTCCCCAGGCTCTCC    38

Ovr107       439 CCGGACCTGGGTCC---------CCGGGGTCCTGACCTGGCGGTTCTGCA    79
                   ||        |||         ||·|||  |||||||           ||
455_051.nt.5  39 CC---------TCCCGCCACTTGCCAGGG--CTGACCT----------CA    67

Ovr107       480 -GGCGGAGCGGGAAGTGGACATCCTGAACCACGTGTTCGACGACGTAGAG   528
                   ·||               ||| ||·||||··||||·|
455_051.nt.5  68 CCGC--------------CAT-CTTAACCGGGTGTCC-------------    89

Ovr107       529 AGCTTTGTATCGAGGCTGCAGAAGTCGGCGGAGGCGGCCAGGGTGCTGGA   578
                   |·||·|·|    ||||                 |·||| ·||||||||·
455_051.nt.5  90 ACCTCTCT-------CTGC---------------CTGCC-TGGTGCTGGC   116

Ovr107       579 GCACCGGGAACGCGGCCGCAGGAGCCGGCGCCGGGCGGCT----GGGGAG   624
                   ·|        ||||·||·|| ··||| |||||·|·|·|||    ···|||
455_051.nt.5 117 CC--------CGCGTCCCCA-TCGCC-GCGCCCGTCTGCTCCCCTCAGAG   156

Ovr107       625 GGCTTGCTGACGCTGCGGGCCAAGCCGCCCTCGGAGGCCGAGTACACCGA   674
                   ||||||||||||||||||||||||||||||||||||||||||||||||||
455_051.nt.5 157 GGCTTGCTGACGCTGCGGGCCAAGCCGCCCTCGGAGGCCGAGTACACCGA   206

Ovr107       675 CGTGCTGCAGAAGATCAAGTACGCCTTCAGCCTGCTGGCCCGGCTGCGCG   724
                   ||||||||||||||||||||||||||||||||||||||||||||||||||
455_051.nt.5 207 CGTGCTGCAGAAGATCAAGTACGCCTTCAGCCTGCTGGCCCGGCTGCGCG   256
```

FIGURE 14 (continued)

```
Ovr107         725 GCAACATCGCCGACCCCTCCTCTCCGGAGCTGTTGCACTTCCTTTTCGGG  774
                   ||||||||||||||||||||||||||||||||||||||||||||||||||
455_051.nt.5   257 GCAACATCGCCGACCCCTCCTCTCCGGAGCTGTTGCACTTCCTTTTCGGG  306

Ovr107         775 CCTCTGCAGATGATTGTGAACACGTCGGGGGGGCCGGAGTTCGCGAGCAG  824
                   ||||||||||||||||||||||||||||||||||||||||||||||||||
455_051.nt.5   307 CCTCTGCAGATGATTGTGAACACGTCGGGGGGGCCGGAGTTCGCGAGCAG  356

Ovr107         825 TGTGCGGCGGCCGCATCTGACATCGGATGCCGTGGCGCTGCTGCGGGACA  874
                   ||||||||||||||||||||||||||||||||||||||||||||||||||
455_051.nt.5   357 TGTGCGGCGGCCGCATCTGACATCGGATGCCGTGGCGCTGCTGCGGGACA  406

Ovr107         875 ACGTCACTCCACGTGAAAACGAGCTCTGGACCTCGCTGGGGGACTCGTGG  924
                   ||||||||||||||||||||||||||||||||||||||||||||||||||
455_051.nt.5   407 ACGTCACTCCACGTGAAAACGAGCTCTGGACCTCGCTGGGGGACTCGTGG  456

Ovr107         925 ACCCGCCCCGGGCTGGAGCTGTCCCCGGAGGAGGGACCCCCATACAGACC  974
                   ||||||||||||||||||||||||||||||||||||||||||||||||||
455_051.nt.5   457 ACCCGCCCCGGGCTGGAGCTGTCCCCGGAGGAGGGACCCCCATACAGACC  506

Ovr107         975 CGAGTTCTTCAGCGGCTGGGAGCCGCCGGTCACTGACCCGCAGAGCCGCG  024
                   ||||||||||||||||||||||||||||||||||||||||||||||||||
455_051.nt.5   507 CGAGTTCTTCAGCGGCTGGGAGCCGCCGGTCACTGACCCGCAGAGCCGCG  556

Ovr107        1025 CCTGGGAGGACCCAGTTGAGAAACAGCTACAGCACGAGCGGAGGCGCCGG 1074
                   ||||||||||||||||||||||||||||||||||||||||||||||||||
455_051.nt.5   557 CCTGGGAGGACCCAGTTGAGAAACAGCTACAGCACGAGCGGAGGCGCCGG  606

Ovr107        1075 CAGCAAAGCGCCCCCCAGGTCGCTGTCAATGGTCACCGAGACTTGGAGCC 1124
                   ||||||||||||||||||||||||||||||||||||||||||||||||||
455_051.nt.5   607 CAGCAAAGCGCCCCCCAGGTCGCTGTCAATGGTCACCGAGACTTGGAGCC  656

Ovr107        1125 AGAATCTGAGCCTCAGCTGGAGTCAGAGACAGCAGGAAAATGGGTCCTGT 1174
                   ||||||||||||||||||||||||||||||||||||||||||||||||||
455_051.nt.5   657 AGAATCTGAGCCTCAGCTGGAGTCAGAGACAGCAGGAAAATGGGTCCTGT  706

Ovr107        1175 GTAATTATGACTTCCAGGCCCGCAACAGCAGTGAGCTGTCGGTCAAGCAG 1224
                   ||||||||||||||||||||||||||||||||||||||||||||||||||
455_051.nt.5   707 GTAATTATGACTTCCAGGCCCGCAACAGCAGTGAGCTGTCGGTCAAGCAG  756

Ovr107        1225 CGGGACGTACTGGAGGTCCTGGATGACAGTCGTAAGTGGTGGAAGGTTCG 1274
                   ||||||||||||||||||||||||||||||||||||||||||||||||||
455_051.nt.5   757 CGGGACGTACTGGAGGTCCTGGATGACAGTCGTAAGTGGTGGAAGGTTCG  806

Ovr107        1275 GGACCCAGCGGGGCAGGAGGGATATGTGCCCTACAACATCCTGACACCCT 1324
                   ||||||||||||||||||||||||||||||||||||||||||||||||||
455_051.nt.5   807 GGACCCAGCGGGGCAGGAGGGATATGTGCCCTACAACATCCTGACACCCT  856

Ovr107        1325 ACCCCGGACCCCGGCTGCACCACAGCCAAAGCCCTGCCCGCAGCCTGAAC 1374
                   ||||||||||||||||||||||||||||||||||||||||||||||||||
455_051.nt.5   857 ACCCCGGACCCCGGCTGCACCACAGCCAAAGCCCTGCCCGCAGCCTGAAC  906

Ovr107        1375 AGCACTCCTCCTCCACCACCAGCCCCAGCCCCGGCCCCACCTCCAGCTCT 1424
                   ||||||||||||||||||||||||||||||||||||||||||||||||||
455_051.nt.5   907 AGCACTCCTCCTCCACCACCAGCCCCAGCCCCGGCCCCACCTCCAGCTCT  956

Ovr107        1425 GGCTCGGCCCCGCTGGGACAGGCCCCGCTGGGACAGCTGCGATAGCCTCA 1474
                   ||||||||||||||||||||||||||||||||||||||||||||||||||
455_051.nt.5   957 GGCTCGGCCCCGCTGGGACAGGCCCCGCTGGGACAGCTGCGATAGCCTCA 1006
```

FIGURE 14 (continued)

```
Ovr107        1475 ACGGCTTGGACCCCAGCGAGAAGGAGAAATTCTCCCAGATGCTCATCGTC 1524
                   ||||||||||||||||||||||||||||||||||||||||||||||||||
455_051.nt.5  1007 ACGGCTTGGACCCCAGCGAGAAGGAGAAATTCTCCCAGATGCTCATCGTC 1056

Ovr107        1525 AACGAGGAACTGCAGGCGCGCCTGGCCCAGGGCCGCTCGGGACCGAGCCG 1574
                   ||||||||||||||||||||||||||||||||||||||||||||||||||
455_051.nt.5  1057 AACGAGGAACTGCAGGCGCGCCTGGCCCAGGGCCGCTCGGGACCGAGCCG 1106

Ovr107        1575 CGCAGTCCCAGGGCCCCGCGCCCCGGAACCGCAGCTCAGCCCGGGCTCGG 1624
                   ||||||||||||||||||||||||||||||||||||||||||||||||||
455_051.nt.5  1107 CGCAGTCCCAGGGCCCCGCGCCCCGGAACCGCAGCTCAGCCCGGGCTCGG 1156

Ovr107        1625 ACGCCTCCGAGGTCCGCGCCTGGCTGCAGGCCAAGGGCTTTAGCTCCGGG 1674
                   ||||||||||||||||||||||||||||||||||||||||||||||||||
455_051.nt.5  1157 ACGCCTCCGAGGTCCGCGCCTGGCTGCAGGCCAAGGGCTTTAGCTCCGGG 1206

Ovr107        1675 ACCGTGGACGCGCTGGGTGTGCTGACCGGGGCGCAGCTTTTCTCGCTGCA 1724
                   ||||||||||||||||||||||||||||||||||||||||||||||||||
455_051.nt.5  1207 ACCGTGGACGCGCTGGGTGTGCTGACCGGGGCGCAGCTTTTCTCGCTGCA 1256

Ovr107        1725 GAGGGAGGAGCTGCGGGCGGTGAGCCCCGAGGAGGGGGCACGTGTGTACA 1774
                   ||·|||||||||||||||||||||||||||||||||||||||||||||||
455_051.nt.5  1257 GAAGGAGGAGCTGCGGGCGGTGAGCCCCGAGGAGGGGGCACGTGTGTACA 1306

Ovr107        1775 GCCAGGTCACCGTGCAGCGCTCGCTGCTGGAGGACAAAGAGAAAGTGTCA 1824
                   ||||||||||||||||||||||||||||||||||||||||||||||||||
455_051.nt.5  1307 GCCAGGTCACCGTGCAGCGCTCGCTGCTGGAGGACAAAGAGAAAGTGTCA 1356

Ovr107        1825 GAGCTGGAGGCAGTGATGGAGAAGCAAAAGAAGAAGGTGGAAGGCGAGGT 1874
                   ||||||||||||||||||||||||||||||||||||||||||||||||||
455_051.nt.5  1357 GAGCTGGAGGCAGTGATGGAGAAGCAAAAGAAGAAGGTGGAAGGCGAGGT 1406

Ovr107        1875 GGAAATGGAGGTCATTTGACCTGCCAGGCGCCCTTCGCAAAGAGTGACGA 1924
                   ||||||||||||||||||||||||||||||||||||||||||||||||||
455_051.nt.5  1407 GGAAATGGAGGTCATTTGACCTGCCAGGCGCCCTTCGCAAAGAGTGACGA 1456

Ovr107        1925 GGCCCCGTGGGAGAACGGACTCCTCAGACTCTCCCCAATAGCGGAAGTCG 1974
                   ||||||||||||||||||||||||||||||||||||||||||||||||||
455_051.nt.5  1457 GGCCCCGTGGGAGAACGGACTCCTCAGACTCTCCCCAATAGCGGAAGTCG 1506

Ovr107        1975 ATCTTCTGAAGGATGGCCAATCTGCTCCGGCCCTGGTCTTCCCCCATCCC 2024
                   ||||||||||||||||||||||||||||||||||||||||||||||||||
455_051.nt.5  1507 ATCTTCTGAAGGATGGCCAATCTGCTCCGGCCCTGGTCTTCCCCCATCCC 1556

Ovr107        2025 GGTGGACAGACTTAACGATCCTTGCTGCAGTCCCTCCGGAGAGGATCTGG 2074
                   ||||||||||||||||||||||||||||||||||||||||||||||||||
455_051.nt.5  1557 GGTGGACAGACTTAACGATCCTTGCTGCAGTCCCTCCGGAGAGGATCTGG 1606

Ovr107        2075 ACTGGCTGGGAGTGGGGAGGGCGTGGAGACAGTCTACGGAAAGCGCTAGC 2124
                   ||||||||||||||||||||||||||||||||||||||||||||||||||
455_051.nt.5  1607 ACTGGCTGGGAGTGGGGAGGGCGTGGAGACAGTCTACGGAAAGCGCTAGC 1656

Ovr107        2125 AGACCCCGAGAGGGTGCAGTGGAGCCCTGAGCATTGTAATATGCGGCCC 2174
                   |||||||||||||||||||||||||||||||||||||||||||||||||
455_051.nt.5  1657 AGACCCCGAGAGGGTGCAGTGGAGCCCTGAGCATTGTAATATGCGGCCC 1706

Ovr107        2175 AGCCTATAAACAGCCTCCGTGCTTAGCAAAAAAAAAAAAAAA--------- 2215
                   |||||||||||||||||||||||||||||·|||||·||||·|
455_051.nt.5  1707 AGCCTATAAACAGCCTCCGTGCTTAGCAGAAAAASAAAAACACATCAACCC 1756
```

FIGURE 14 (continued)

```
Ovr107           2216 AAAAAA                                              2221
                      ||·|||
455_051.nt.5     1757 AACAAACGTTTGGGGTATTCCATGGCCAATACCGTTGTTCCCGTGTGTGA   1806

Ovr107           2222                                                     2221

455_051.nt.5     1807 ACATTGTTATTTCAGCTCACATTTCCCACAGTATTGGAACAACACATCAT   1856

Ovr107           2222                                                     2221

455_051.nt.5     1857 ACCACACACACACAGAACCAATCGAGATATATAAACCCAATGCACACTCA   1906

Ovr107           2222                                                     2221

455_051.nt.5     1907 AACACCTAAT                                           1916
```

FIGURE 15

```
Ovr107        1 AGAGCAAGGAAGGGCAGGGGACCTGGGAAGGAAGTTCTGGAAGGCAGTGG  50

455_051.nt.6  1                                                      0

Ovr107       51 GGTTTGAGATTGGACCCAGGGTCAAGATAGAACATGAAGGTGGGATGAGG 100

455_051.nt.6  1                                                      0

Ovr107      101 ACATGAACAGAACATGGCCAAGAAGGATCTGGGGGAGCAGCCAGGACGAG  50

455_051.nt.6  1                                                      0

Ovr107      151 GCGGAGCTGATCCGAGAGGACATCCAGGGGGCTCTGCACAATTACCGCTC 200

455_051.nt.6  1                                                      0

Ovr107      201 GGGCCGCGGGGAGCGCAGGGCGGCGGCGCTCAGGGCCACGCAGGAGGAGT 250

455_051.nt.6  1                                                      0

Ovr107      251 TGCAGCGCGACCGCTCGCCCGCCGCTGAGACCCCGCCCCTGCAGCGCCGC 300

455_051.nt.6  1                                                      0

Ovr107      301 CCGTCAGTCCGCGCAGTGATCAGCACCGTAGAGCGGGGCGCGGGCCGCGG 350

455_051.nt.6  1                                                      0

Ovr107      351 ACGACCCCAGGCGAAGCCCATTCCCGAGGCAGAGGAGGCGCAGAGGCCTG 400

455_051.nt.6  1                                                      0

Ovr107      401 AGCCGGTGGGGACCTCGAGCAA-------CGCTGACTC----GGC-CTCC 438
                   ||·|||···|||       ||||   |||   |||·|||
455_051.nt.6  1                  GATCTCTTCCAAATGTCCCCGCT--CTCCCCAGGCTCTCC  38

Ovr107      439 CCGGACCTGGGTCC---------CCGGGGTCCTGACCTGGCGGTTCTGCA 479
                   ||          |||        ||·|||  |||||||         ||
455_051.nt.6 39 CC---------TCCCGCCACTTGCCAGGG--CTGACCT----------CA  67

Ovr107      480 -GGCGGAGCGGGAAGTGGACATCCTGAACCACGTGTTCGACGACGTAGAG 528
                 ·||               |||  ||·|||||··||||·|
455_051.nt.6 68 CCGC--------------CAT-CTTAACCGGGTGTCC-----------   89

Ovr107      529 AGCTTTGTATCGAGGCTGCAGAAGTCGGCGGAGGCGGCCAGGGTGCTGGA 578
                 |·||·|·|       ||||                 |·|||  ·||||||||·
455_051.nt.6 90 ACCTCTCT-------CTGC---------------CTGCC-TGGTGCTGGC 116

Ovr107      579 GCACCGGGAACGCGGCCGCAGGAGCCGGCGCCGGGCGGCT----GGGGAG 624
                 |            ||||·||·||   ··|||  |||||·|·|·|||    ···|||
455_051.nt.6 117 CC---------CGCGTCCCCA-TCGCC-GCGCCGTCTGCTCCCCTCAGAG 156

Ovr107      625 GGCTTGCTGACGCTGCGGGCCAAGCCGCCCTCGGAGGCCGAGTACACCGA 674
                 ||||||||||||||||||||||||||||||||||||||||||||||||||
455_051.nt.6 157 GGCTTGCTGACGCTGCGGGCCAAGCCGCCCTCGGAGGCCGAGTACACCGA 206

Ovr107      675 CGTGCTGCAGAAGATCAAGTACGCCTTCAGCCTGCTGGCCCGGCTGCGCG 724
                 ||||||||||||||||||||||||||||||||||||||||||||||||||
455_051.nt.6 207 CGTGCTGCAGAAGATCAAGTACGCCTTCAGCCTGCTGGCCCGGCTGCGCG 256
```

FIGURE 15 (continued)

```
Ovr107        725 GCAACATCGCCGACCCCTCCTCTCCGGAGCTGTTGCACTTCCTTTTCGGG 774
                  ||||||||||||||||||||||||||||||||||||||||||||||||||
455_051.nt.6  257 GCAACATCGCCGACCCCTCCTCTCCGGAGCTGTTGCACTTCCTTTTCGGG 306

Ovr107        775 CCTCTGCAGATGATTGTGAACACGTCGGGGGGGCCGGAGTTCGCGAGCAG 824
                  ||||||||||||||||||||||||||||||||||||||||||||||||||
455_051.nt.6  307 CCTCTGCAGATGATTGTGAACACGTCGGGGGGGCCGGAGTTCGCGAGCAG 356

Ovr107        825 TGTGCGGCGGCCGCATCTGACATCGGATGCCGTGGCGCTGCTGCGGGACA 874
                  ||||||||||||||||||||||||||||||||||||||||||||||||||
455_051.nt.6  357 TGTGCGGCGGCCGCATCTGACATCGGATGCCGTGGCGCTGCTGCGGGACA 406

Ovr107        875 ACGTCACTCCACGTGAAAACGAGCTCTGGACCTCGCTGGGGGACTCGTGG 924
                  ||||||||||||||||||||||||||||||||||||||||||||||||||
455_051.nt.6  407 ACGTCACTCCACGTGAAAACGAGCTCTGGACCTCGCTGGGGGACTCGTGG 456

Ovr107        925 ACCCGCCCCGGGCTGGAGCTGTCCCCGGAGGAGGGACCCCCATACAGACC 974
                  ||||||||||||||||||||||||||||||||||||||||||||||||||
455_051.nt.6  457 ACCCGCCCCGGGCTGGAGCTGTCCCCGGAGGAGGGACCCCCATACAGACC 506

Ovr107        975 CGAGTTCTTCAGCGGCTGGGAGCCGCCGGTCACTGACCCGCAGAGCCGCG 024
                  ||||||||||||||||||||||||||||||||||||||||||||||||||
455_051.nt.6  507 CGAGTTCTTCAGCGGCTGGGAGCCGCCGGTCACTGACCCGCAGAGCCGCG 556

Ovr107       1025 CCTGGGAGGACCCAGTTGAGAAACAGCTACAGCACGAGCGGAGGCGCCGG 074
                  ||||||||||||||||||||||||||||||||||||||||||||||||||
455_051.nt.6  557 CCTGGGAGGACCCAGTTGAGAAACAGCTACAGCACGAGCGGAGGCGCCGG 606

Ovr107       1075 CAGCAAAGCGCCCCCAGGTCGCTGTCAATGGTCACCGAGACTTGGAGCC 1124
                  ||||||||||||||||||||||||||||||||||||||||||||||||||
455_051.nt.6 607 CAGCAAAGCGCCCCCAGGTCGCTGTCAATGGTCACCGAGACTTGGAGCC  656

Ovr107       1125 AGAATCTGAGCCTCAGCTGGAGTCAGAGACAGCAGGAAAATGGGTCCTGT 1174
                  ||||||||||||||||||||||||||||||||||||||||||||||||||
455_051.nt.6 657 AGAATCTGAGCCTCAGCTGGAGTCAGAGACAGCAGGAAAATGGGTCCTGT  706

Ovr107       1175 GTAATTATGACTTCCAGGCCCGCAACAGCAGTGAGCTGTCGGTCAAGCAG 1224
                  ||||||||||||||||||||||||||||||||||||||||||||||||||
455_051.nt.6 707 GTAATTATGACTTCCAGGCCCGCAACAGCAGTGAGCTGTCGGTCAAGCAG  756

Ovr107       1225 CGGGACGTACTGGAGGTCCTGGATGACAGTCGTAAGTGGTGGAAGGTTCG 1274
                  ||||||||||||||||||||||||||||||||||||||||||||||||||
455_051.nt.6 757 CGGGACGTACTGGAGGTCCTGGATGACAGTCGTAAGTGGTGGAAGGTTCG  806

Ovr107       1275 GGACCCAGCGGGGCAGGAGGGATATGTGCCCTACAACATCCTGACACCCT 1324
                  ||||||||||||||||||||||||||||||||||||||||||||||||||
455_051.nt.6 807 GGACCCAGCGGGGCAGGAGGGATATGTGCCCTACAACATCCTGACACCCT  856

Ovr107       1325 ACCCCGGACCCCGGCTGCACCACAGCCAAAGCCCTGCCCGCAGCCTGAAC 1374
                  ||||||||||||||||||||||||||||||||||||||||||||||||||
455_051.nt.6 857 ACCCCGGACCCCGGCTGCACCACAGCCAAAGCCCTGCCCGCAGCCTGAAC  906

Ovr107       1375 AGCACTCCTCCTCCACCACCAGCCCCAGCCCCGGCCCCACCTCCAGCTCT 1424
                  ||||||||||||||||||||||||||||||||||||||||||||||||||
455_051.nt.6 907 AGCACTCCTCCTCCACCACCAGCCCCAGCCCCGGCCCCACCTCCAGCTCT  956

Ovr107       1425 GGCTCGGCCCCGCTGGGACAGGCCCCGCTGGGACAGCTGCGATAGCCTCA 1474
                  ||||||||||||||||||||||||||||||||||||||||||||||||||
455_051.nt.6 957 GGCTCGGCCCCGCTGGGACAGGCCCCGCTGGGACAGCTGCGATAGCCTCA 1006
```

FIGURE 15 (continued)

```
Ovr107        1475 ACGGCTTGGACCCCAGCGAGAAGGAGAAATTCTCCCAGATGCTCATCGTC 1524
                   ||||||||||||||||||||||||||||||||||||||||||||||||||
455_051.nt.6 1007 ACGGCTTGGACCCCAGCGAGAAGGAGAAATTCTCCCAGATGCTCATCGTC 1056

Ovr107        1525 AACGAGGAACTGCAGGCGCGCCTGGCCCAGGGCCGCTCGGGACCGAGCCG 1574
                   ||||||||||||||||||||||||||||||||||||||||||||||||||
455_051.nt.6 1057 AACGAGGAACTGCAGGCGCGCCTGGCCCAGGGCCGCTCGGGACCGAGCCG 1106

Ovr107        1575 CGCAGTCCCAGGGCCCCGCGCCCCGGAACCGCAGCTCAGCCCGGGCTCGG 1624
                   ||||||||||||||||||||||||||||||||||||||||||||||||||
455_051.nt.6 1107 CGCAGTCCCAGGGCCCCGCGCCCCGGAACCGCAGCTCAGCCCGGGCTCGG 1156

Ovr107        1625 ACGCCTCCGAGGTCCGCGCCTGGCTGCAGGCCAAGGGCTTTAGCTCCGGG 1674
                   ||||||||||||||||||||||||||||||||||||||||||||||||||
455_051.nt.6 1157 ACGCCTCCGAGGTCCGCGCCTGGCTGCAGGCCAAGGGCTTTAGCTCCGGG 1206

Ovr107        1675 ACCGTGGACGCGCTGGGTGTGCTGACCGGGGCGCAGCTTTTCTCGCTGCA 1724
                   ||||||||||||||||||||||||||||||||||||||||||||||||||
455_051.nt.6 1207 ACCGTGGACGCGCTGGGTGTGCTGACCGGGGCGCAGCTTTTCTCGCTGCA 1256

Ovr107        1725 GAGGGAGGAGCTGCGGGCGGTGAGCCCCGAGGAGGGGGCACGTGTGTACA 1774
                   ||-|||||||||||||||||||||||||||||||||||||||||||||||
455_051.nt.6 1257 GAAGGAGGAGCTGCGGGCGGTGAGCCCCGAGGAGGGGGCACGTGTGTACA 1306

Ovr107        1775 GCCAGGTCACCGTGCAGCGCTCGCTGCTGGAGGACAAAGAGAAAGTGTCA 1824
                   ||||||||||||||||||||||||||||||||||||||||||||||||||
455_051.nt.6 1307 GCCAGGTCACCGTGCAGCGCTCGCTGCTGGAGGACAAAGAGAAAGTGTCA 1356

Ovr107        1825 GAGCTGGAGGCAGTGATGGAGAAGCAAAAGAAGAAGGTGGAAGGCGAGGT 1874
                   ||||||||||||||||||||||||||||||||||||||||||||||||||
455_051.nt.6 1357 GAGCTGGAGGCAGTGATGGAGAAGCAAAAGAAGAAGGTGGAAGGCGAGGT 1406

Ovr107        1875 GGAAATGGAGGTCATTTGACCTGCCAGGCGCCCTTCGCAAAGAGTGACGA 1924
                   ||||||||||||||||||||||||||||||||||||||||||||||||||
455_051.nt.6 1407 GGAAATGGAGGTCATTTGACCTGCCAGGCGCCCTTCGCAAAGAGTGACGA 1456

Ovr107        1925 GGCCCCGTGGGAGAACGGACTCCTCAGACTCTCCCCAATAGCGGAAGTCG 1974
                   ||||||||||||||||||||||||||||||||||||||||||||||||||
455_051.nt.6 1457 GGCCCCGTGGGAGAACGGACTCCTCAGACTCTCCCCAATAGCGGAAGTCG 1506

Ovr107        1975 ATCTTCTGAAGGATGGCCAATCTGCTCCGGCCCTGGTCTTCCCCCATCCC 2024
                   ||||||||||||||||||||||||||||||||||||||||||||||||||
455_051.nt.6 1507 ATCTTCTGAAGGATGGCCAATCTGCTCCGGCCCTGGTCTTCCCCCATCCC 1556

Ovr107        2025 GGTGGACAGACTTAACGATCCTTGCTGCAGTCCCTCCGGAGAGGATCTGG 2074
                   ||||||||||||||||||||||||||||||||||||||||||||||||||
455_051.nt.6 1557 GGTGGACAGACTTAACGATCCTTGCTGCAGTCCCTCCGGAGAGGATCTGG 1606

Ovr107        2075 ACTGGCTGGGAGTGGGGAGGGCGTGGAGACAGTCTACGGAAAGCGCTAGC 2124
                   ||||||||||||||||||||||||||||||||||||||||||||||||||
455_051.nt.6 1607 ACTGGCTGGGAGTGGGGAGGGCGTGGAGACAGTCTACGGAAAGCGCTAGC 1656

Ovr107        2125 AGACCCCCGAGAGGGTGCAGTGGAGCCCTGAGCATTGTAATATGCGGCCC 2174
                   ||||||||||||||||||||||||||||||||||||||||||||||||||
455_051.nt.6 1657 AGACCCCCGAGAGGGTGCAGTGGAGCCCTGAGCATTGTAATATGCGGCCC 1706

Ovr107        2175 AGCCTATAAACAGCCTCCGTGCTTAGCAAAAAAAAAAAAAAAAAAAAA    2221
                   |||||||||||||||||||||||||||||-
455_051.nt.6 1707 AGCCTATAAACAGCCTCCGTGCTTAGCAG                      1735
```

FIGURE 16

```
Ovr110     1   GAGTCACCAAGGAAGGCAGCGGCAGCTCCACTCAGCCAGTACCCAGA      47
               |||||||||||||||||||||||||| |||||||||||||||||||||
Ovr110v1   1   TGTGAGTCACCAAGGAAGGCAGCGGCA-CTCCACTCAGCCAGTACCCAGA   49

Ovr110    48   TACGCTGGGAACCTTCCCCAGCCATGGCTTCCCTGGGGCAGATCCTCTTC   97
               ||||||||||||||||||||||||||||||||||||||||||||||||||
Ovr110v1  50   TACGCTGGGAACCTTCCCCAGCCATGGCTTCCCTGGGGCAGATCCTCTTC   99

Ovr110    98   TGGAGCATAATTAGCATCATCATTATTCTGGCTGGAGCAATTGCACTCAT  147
               ||||||||||||||||||||||||||||||||||||||||||||||||||
Ovr110v1 100   TGGAGCATAATTAGCATCATCATTATTCTGGCTGGAGCAATTGCACTCAT  149

Ovr110   148   CATTGGCTTTGGTATTT---------------------------------  164
               |||||||||||||||||
Ovr110v1 150   CATTGGCTTTGGTATTTCAGAAGTCTCTGTCTGGCTTTCAGCAATGAAGG  199

Ovr110   165   --------------------------------------------------  164

Ovr110v1 200   GTTTGGTTGTAGAAGTTCCAAGGCTTCCCTTAGCATTGATCTTTGCTTCC  249

Ovr110   165   -------CAGGGAGACACTCCATCACAGTCACTACTGTCGCCTCAGCTGG  207
                      |||||||||||||||||||||||||||||||||||||||||||
Ovr110v1 250   TGAACTGCAGGGAGACACTCCATCACAGTCACTACTGTCGCCTCAGCTGG  299

Ovr110   208   GAACATTGGGGAGGATGGAATCCAGAGCTGCACTTTTGAACCTGACATCA  257
               |||||||||||||||||||||||||-||||||||||||||||||||||||
Ovr110v1 300   GAACATTGGGGAGGATGGAATCCTGAGCTGCACTTTTGAACCTGACATCA  349

Ovr110   258   AACTTTCTGATATCGTGATACAATGGCTGAAGGAAGGTGTTTTAGGCTTG  307
               ||||||||||||||||||||||||||||||||||||||||||||||||||
Ovr110v1 350   AACTTTCTGATATCGTGATACAATGGCTGAAGGAAGGTGTTTTAGGCTTG  399

Ovr110   308   GTCCATGAGTTCAAAGAAGGCAAAGATGAGCTGTCGGAGCAGGATGAAAT  357
               ||||||||||||||||||||||||||||||||||||||||||||||||||
Ovr110v1 400   GTCCATGAGTTCAAAGAAGGCAAAGATGAGCTGTCGGAGCAGGATGAAAT  449

Ovr110   358   GTTCAGAGGCCGGACAGCAGTGTTTGCTGATCAAGTGATAGTTGGCAATG  407
               ||||||||||||||||||||||||||||||||||||||||||||||||||
Ovr110v1 450   GTTCAGAGGCCGGACAGCAGTGTTTGCTGATCAAGTGATAGTTGGCAATG  499

Ovr110   408   CCTCTTTGCGGCTGAAAAACGTGCAACTCACAGATGCTGGCACCTACAAA  457
               ||||||||||||||||||||||||||||||||||||||||||||||||||
Ovr110v1 500   CCTCTTTGCGGCTGAAAAACGTGCAACTCACAGATGCTGGCACCTACAAA  549

Ovr110   458   TGTTATATCATCACTTCTAAAGGCAAGGGGAATGCTAACCTTGAGTATAA  507
               ||||||||||||||||||||||||||||||||||||||||||||||||||
Ovr110v1 550   TGTTATATCATCACTTCTAAAGGCAAGGGGAATGCTAACCTTGAGTATAA  599

Ovr110   508   AACTGGAGCCTTCAGCATGCCGGAAGTGAATGTGGACTATAATGCCAGCT  557
               ||||||||||||||||||||||||||||||||||||||||||||||||||
Ovr110v1 600   AACTGGAGCCTTCAGCATGCCGGAAGTGAATGTGGACTATAATGCCAGCT  649

Ovr110   558   CAGAGACCTTGCGGTGTGAGGCTCCCCGATGGTTCCCCCAGCCCACAGTG  607
               ||||||||||||||||||||||||||||||||||||||||||||||||||
Ovr110v1 650   CAGAGACCTTGCGGTGTGAGGCTCCCCGATGGTTCCCCCAGCCCACAGTG  699

Ovr110   608   GTCTGGGCATCCCAAGTTGACCAGGGAGCCAACTTCTCGGAAGTCTCCAA  657
               ||||||||||||||||||||||||||||||||||||||||||||||||||
Ovr110v1 700   GTCTGGGCATCCCAAGTTGACCAGGGAGCCAACTTCTCGGAAGTCTCCAA  749
```

FIGURE 16 (continued)

```
Ovr110     658  TACCAGCTTTGAGCTGAACTCTGAGAATGTGACCATGAAGGTTGTGTCTG   707
                |||||||||||||||||||||||||||||||||||||||||||||||||||
Ovr110v1   750  TACCAGCTTTGAGCTGAACTCTGAGAATGTGACCATGAAGGTTGTGTCTG   799

Ovr110     708  TGCTCTACAATGTTACGATCAACAACACATACTCCTGTATGATTGAAAAT   757
                |||||||||||||||||||||||||||||||||||||||||||||||||||
Ovr110v1   800  TGCTCTACAATGTTACGATCAACAACACATACTCCTGTATGATTGAAAAT   849

Ovr110     758  GACATTGCCAAAGCAACAGGGGATATCAAAGTGACAGAATCGGAGATCAA   807
                |||||||||||||||||||||||||||||||||||||||||||||||||||
Ovr110v1   850  GACATTGCCAAAGCAACAGGGGATATCAAAGTGACAGAATCGGAGATCAA   899

Ovr110     808  AAGGCGGAGTCACCTACAGCTGCTAAACTCAAAGGCTTCTCTGTGTGTCT   857
                |||||||||||||||||||||||||||||||||||||||||||||||||||
Ovr110v1   900  AAGGCGGAGTCACCTACAGCTGCTAAACTCAAAGGCTTCTCTGTGTGTCT   949

Ovr110     858  CTTCTTTCTTTGCCATCAGCTGGGCACTTCTGCCTCTCAGCCCTTACCTG   907
                |||||||||||||||||||||||||||||||||||||||||||||||||||
Ovr110v1   950  CTTCTTTCTTTGCCATCAGCTGGGCACTTCTGCCTCTCAGCCCTTACCTG   999

Ovr110     908  ATGCTAAAATAATGTGCCTCGGCCACAAAAAAGCATGCAAAGTCATTGTT   957
                |||||||||||||||||||||| |||||||||||||||||||||||||||
Ovr110v1  1000  TGCTAAAATAATGTGCCTTGGCCACAAAAAAGCATGCAAAGTCATTGTT  1049

Ovr110     958  ACAACAGGGATCTACAGAACTATTTCACCACCAGATATGACCTAGTTTTA  1007
                |||||||||||||||||||||||||||||||||||||||||||||||||||
Ovr110v1  1050  ACAACAGGGATCTACAGAACTATTTCACCACCAGATATGACCTAGTTTTA  1099

Ovr110    1008  TATTTCTGGGAGGAAATGAATTCATATCTAGAAGTCTGGAGTGAGCAAAC  1057
                |||||||||||||||||||||||||||||||||||||||||||||||||||
Ovr110v1  1100  TATTTCTGGGAGGAAATGAATTCATATCTAGAAGTCTGGAGTGAGCAAAC  1149

Ovr110    1058  AAGAGCAAGAAACAAAAAGAAGCCAAAAGCAGAAGGCTCCAATATGAACA  1107
                |||||||||||||||||||||||||||||||||||||||||||||||||||
Ovr110v1  1150  AAGAGCAAGAAACAAAAAGAAGCCAAAAGCAGAAGGCTCCAATATGAACA  1199

Ovr110    1108  AGATAAATCTATCTTCAAAGACATATTAGAAGTTGGGAAAATAATTCATG  1157
                |||||||||||||||||||||||||||||||||||||||||||||||||||
Ovr110v1  1200  AGATAAATCTATCTTCAAAGACATATTAGAAGTTGGGAAAATAATTCATG  1249

Ovr110    1158  TGAACTAGA-----------------------------------------  1166
                |||||||||
Ovr110v1  1250  TGAACTAGACAAGTGTGTTAAGAGTGATAAGTAAAATGCACGTGGAGACA  1299

Ovr110    1167  --------------------------------------------------  1166

Ovr110v1  1300  AGTGCATCCCCAGATCTCAGGGACCTCCCCCTGCCTGTCACCTGGGGAGT  1349

Ovr110    1167  --------------------------------------------------  1166

Ovr110v1  1350  GAGAGGACAGGATAGTGCATGTTCTTTGTCTCTGAATTTTTAGTTATATG  1399

Ovr110    1167  --------------------------------------------------  1166

Ovr110v1  1400  TGCTGTAATGTTGCTCTGAGGAAGCCCCTGGAAAGTCTATCCCAACATAT  1449

Ovr110    1167  --------------------------------------------------  1166

Ovr110v1  1450  CCACATCTTATATTCCACAAATTAAGCTGTAGTATGTACCCTAAGACGCT  1499
```

FIGURE 16 (continued)

```
Ovr110    1167 ---------------------------------------------------- 1166
Ovr110v1  1500 GCTAATTGACTGCCACTTCGCAACTCAGGGGCGGCTGCATTTTAGTAATG 1549

Ovr110    1167 ---------------------------------------------------- 1166
Ovr110v1  1550 GGTCAAATGATTCACTTTTTATGATGCTTCCAAAGGTGCCTTGGCTTCTC 1599

Ovr110    1167 ---------------------------------------------------- 1166
Ovr110v1  1600 TTCCCAACTGACAAATGCCAAAGTTGAGAAAAATGATCATAATTTTAGCA 1649

Ovr110    1167 ---------------------------------------------------- 1166
Ovr110v1  1650 TAAACAGAGCAGTCGGCGACACCGATTTTATAAATAAACTGAGCACCTTC 1699

Ovr110    1167 ---------------------------------------------------- 1166
Ovr110v1  1700 TTTTTAAACAAACAAATGCGGGTTTATTTCTCAGATGATGTTCATCCGTG 1749

Ovr110    1167 ---------------------------------------------------- 1166
Ovr110v1  1750 AATGGTCCAGGGAAGGACCTTTCACCTTGACTATATGGCATTATGTCATC 1799

Ovr110    1167 ---------------------------------------------------- 1166
Ovr110v1  1800 ACAAGCTCTGAGGCTTCTCCTTTCCATCCTGCGTGGACAGCTAAGACCTC 1849

Ovr110    1167 ---------------------------------------------------- 1166
Ovr110v1  1850 AGTTTTCAATAGCATCTAGAGCAGTGGGACTCAGCTGGGGTGATTTCGCC 1899

Ovr110    1167 ---------------------------------------------------- 1166
Ovr110v1  1900 CCCCATCTCCGGGGGAATGTCTGAAGACAATTTTGGTTACCTCAATGAGG 1949

Ovr110    1167 ---------------------------------------------------- 1166
Ovr110v1  1950 GAGTGGAGGAGGATACAGTGCTACTACCAACTAGTGGATAAAGGCCAGGG 1999

Ovr110    1167 ---------------------------------------------------- 1166
Ovr110v1  2000 ATGCTGCTCAACCTCCTACCATGTACAGGACGTCTCCCCATTACAACTAC 2049

Ovr110    1167 -----------GTCAACTGTGTCAGGGCTAAGAAACCCTGGTTTTGAGT 1204
                           ||||||||||||| ||||||||||||||||||||||||
Ovr110v1  2050 CCAATCCGAAGTGTCAACTGTGTCAGGACTAAGAAACCCTGGTTTTGAGT 2099

Ovr110    1205 AGAAAAGGGCCTGGAAAGAGGGGAGCCAACAAATCTGTCTGCTTCCTCAC 1254
               ||||||||||||||||||||||||||||||||||||||||||||||||||
Ovr110v1  2100 AGAAAAGGGCCTGGAAAGAGGGGAGCCAACAAATCTGTCTGCTTCCTCAC 2149

Ovr110    1255 ATTAGTCATTGGCAAATAAGCATTCTGTCTCTTTGGCTGCTGCCTCAGCA 1304
               ||||||||||||||||||||||||||||||||||||||||||||||||||
Ovr110v1  2150 ATTAGTCATTGGCAAATAAGCATTCTGTCTCTTTGGCTGCTGCCTCAGCA 2199

Ovr110    1305 CAGAGAGCCAGAACTCTATCGGGCACCAGGATAACATCTCTCAGTGAACA 1354
               ||||||||||||||||||||||||||||||||||||||||||||||||||
Ovr110v1  2200 CAGAGAGCCAGAACTCTATCGGGCACCAGGATAACATCTCTCAGTGAACA 2249
```

FIGURE 16 (continued)

```
Ovr110    1355 GAGTTGACAAGGCCTATGGGAAATGCCTGATGGGATTATCTTCAGCTTGT 1404
               ||||||||||||||||||||||||||||||||||||||||||||||||||
Ovr110v1  2250 GAGTTGACAAGGCCTATGGGAAATGCCTGATGGGATTATCTTCAGCTTGT 2299

Ovr110    1405 TGAGCTTCTAAGTTTCTTTCCCTTCATTCTACCCTGCAAGCCAAGTTCTG 1454
               ||||||||||||||||||||||||||||||||||||||||||||||||||
Ovr110v1  2300 TGAGCTTCTAAGTTTCTTTCCCTTCATTCTACCCTGCAAGCCAAGTTCTG 2349

Ovr110    1455 TAAGAGAAATGCCTGAGTTCTAGCTCAGGTTTTCTTACTCTGAATTTAGA 1504
               ||||||||||||||||||||||||||||||||||||||||||||||||||
Ovr110v1  2350 TAAGAGAAATGCCTGAGTTCTAGCTCAGGTTTTCTTACTCTGAATTTAGA 2399

Ovr110    1505 TCTCCAGACCCTGCCTGGCCACAATTCAAATTAAGGCAACAAACATATAC 1554
               ||||||||||||| ||||||||||||||||||||||||||||||||||||
Ovr110v1  2400 TCTCCAGACCCTTCCTGGCCACAATTCAAATTAAGGCAACAAACATATAC 2449

Ovr110    1555 CTTCCATGAAGCACACACAGACTTTTGAAAGCAAGGACAATGACTGCTTG 1604
               ||||||||||||||||||||||||||||||||||||||||||||||||||
Ovr110v1  2450 CTTCCATGAAGCACACACAGACTTTTGAAAGCAAGGACAATGACTGCTTG 2499

Ovr110    1605 AATTGAGGCCTTGAGGAATGAAGCTTTGAAGGAAAAGAATACTTTGTTTC 1654
               ||||||||||||||||||||||||||||||||||||||||||||||||||
Ovr110v1  2500 AATTGAGGCCTTGAGGAATGAAGCTTTGAAGGAAAAGAATACTTTGTTTC 2549

Ovr110    1655 CAGCCCCCTTCCCACACTCTTCATGTGTTAACCACTGCCTTCCTGGACCT 1704
               ||||||||||||||||||||||||||||||||||||||||||||||||||
Ovr110v1  2550 CAGCCCCCTTCCCACACTCTTCATGTGTTAACCACTGCCTTCCTGGACCT 2599

Ovr110    1705 TGGAGCCACGGTGACTGTATTACATGTTGTTATAGAAAACTGATTTTAGA 1754
               ||||||||||||||||||||||||||||||||||||||||||||||||||
Ovr110v1  2600 TGGAGCCACGGTGACTGTATTACATGTTGTTATAGAAAACTGATTTTAGA 2649

Ovr110    1755 GTTCTGATCGTTCAAGAGAATGATTAAATATACATTTCCTAAAAAAAAAA 1804
               |||||||||||||||||||||||||||||||||||||||||
Ovr110v1  2650 GTTCTGATCGTTCAAGAGAATGATTAAATATACATTTCCTA         2690

Ovr110    1805 AAAAAAA                                           1811

Ovr110v1  2691                                                   2690
```

FIGURE 17

```
Ovr110        1 MASLGQILFWSIISIIIILAGAIALIIGFGISGRHSITVTTVASAGNIGE   50
                ||||||||||||||||||||||||||||||||||    .::|...|..|.:.|
455_053.aa.2  1 MASLGQILFWSIISIIIILAGAIALIIGFGIS---EVSVWLSAMKGLVVE   47

Ovr110       51 DGIQSCTFEPDIKLSDIVIQWLKEGVLGLVHEFKEGKDELSEQDEMFRGR  100
                         .|.:.|:.|...
455_053.aa.2 48 --------VPRLPLALIFAS                                59

Ovr110      101 TAVFADQVIVGNASLRLKNVQLTDAGTYKCYIITSKGKGNANLEYKTGAF  150

455_053.aa.2 60                                                     59

Ovr110      151 SMPEVNVDYNASSETLRCEAPRWFPQPTVVWASQVDQGANFSEVSNTSFE  200

455_053.aa.2 60                                                     59

Ovr110      201 LNSENVTMKVVSVLYNVTINNTYSCMIENDIAKATGDIKVTESEIKRRSH  250

455_053.aa.2 60                                                     59

Ovr110      251 LQLLNSKASLCVSSFFAISWALLPLSPYLMLK                    282

```
Ovr110        1 MASLGQILFWSIISIIIILAGAIALIIGFGISGRHSITVTTVASAGNIGE    50
                            .:||||||||||||||||||||
455_053.aa.3  1                         TAGRHSITVTTVASAGNIGE    20

Ovr110       51 DGIQSCTFEPDIKLSDIVIQWLKEGVLGLVHEFKEGKDELSEQDEMFRGR   100
                |||.||||||||||||||||||||||||||||||||||||||||||||||
455_053.aa.3 21 DGILSCTFEPDIKLSDIVIQWLKEGVLGLVHEFKEGKDELSEQDEMFRGR    70

Ovr110      101 TAVFADQVIVGNASLRLKNVQLTDAGTYKCYIITSKGKGNANLEYKTGAF   150
                ||||||||||||||||||||||||||||||||||||||||||||||||||
455_053.aa.3 71 TAVFADQVIVGNASLRLKNVQLTDAGTYKCYIITSKGKGNANLEYKTGAF   120

Ovr110      151 SMPEVNVDYNASSETLRCEAPRWFPQPTVVWASQVDQGANFSEVSNTSFE   200
                ||||||||||||||||||||||||||||||||||||||||||||||||||
455_053.aa.3 121 SMPEVNVDYNASSETLRCEAPRWFPQPTVVWASQVDQGANFSEVSNTSFE   170

Ovr110      201 LNSENVTMKVVSVLYNVTINNTYSCMIENDIAKATGDIKVTESEIKRRSH   250
                ||||||||||||||||||||||||||||||||||||||||||||||||||
455_053.aa.3 171 LNSENVTMKVVSVLYNVTINNTYSCMIENDIAKATGDIKVTESEIKRRSH   220

Ovr110      251 LQLLNSKASLCVSSFFAISWALLPLSPYLMLK                     282
                |||||||||||||||||||||||||||||||
455_053.aa.3 221 LQLLNSKASLCVSSFFAISWALLPLSPYLMLK                     252
```

COMPOSITIONS, SPLICE VARIANTS AND METHODS RELATING TO OVARIAN SPECIFIC GENES AND PROTEINS

INTRODUCTION

This patent application is a continuation of U.S. application Ser. No. 10/537,743, filed Nov. 9, 2006 now abandoned, which is the U.S. National Stage of International Application No. PCT/US2003/38855, filed Dec. 8, 2003, which claims the benefit of priority from U.S. Provisional Patent Application Ser. No. 60/431,321 filed Dec. 6, 2002, U.S. Provisional Patent Application Ser. No. 60/431,301 filed Dec. 6, 2002, U.S. Provisional Patent Application Ser. No. 60/484,584 filed Jun. 30, 2003 and U.S. Provisional Patent Application Ser. No. 60/518,607, filed Nov. 7, 2003, which are herein incorporated by reference in their entireties.

FIELD OF THE INVENTION

The present invention relates to newly identified nucleic acids and polypeptides present in normal and neoplastic ovarian cells, including fragments, variants and derivatives of the nucleic acids and polypeptides. The present invention also relates to antibodies to the polypeptides of the invention, as well as agonists and antagonists of the polypeptides of the invention. The invention also relates to compositions comprising the nucleic acids, polypeptides, antibodies, post translational modifications (PTMs), variants, derivatives, agonists and antagonists thereto and methods for the use of these compositions. These uses include identifying, diagnosing, monitoring, staging, imaging and treating ovarian cancer and/or non-cancerous disease states in ovarian, identifying ovarian tissue and monitoring and identifying and/or designing agonists and antagonists of polypeptides of the invention. The uses also include gene therapy, therapeutic molecules including but not limited to antibodies or antisense molecules, production of transgenic animals and cells, and production of engineered ovarian tissue for treatment and research.

BACKGROUND OF THE INVENTION

Cancer of the ovaries is the fourth-most common cause of cancer death in women in the United States, with more than 23,000 new cases and roughly 14,000 deaths predicted for the year 2001. Shridhar, V. et al., *Cancer Res.* 61(15):5895-904 (2001); Memarzadeh, S. & Berek, J. S., *J. Reprod. Med.* 46(7):621-29 (2001). The incidence of ovarian cancer is of serious concern worldwide, with an estimated 191,000 new cases predicted annually. Runnebaum, I. B. & Stickeler, E., *J. Cancer Res. Clin. Oncol.* 127(2):73-79 (2001). These numbers continue to rise today. In the United States alone, it is estimated there will be 25,400 new cases of ovarian cancer, and 14,300 deaths due to ovarian cancer in 2003. (American Cancer Society Website: cancer.org on the world wide web). Unfortunately, women with ovarian cancer are typically asymptomatic until the disease has metastasized. Because effective screening for ovarian cancer is not available, roughly 70% of women diagnosed have an advanced stage of the cancer with a five-year survival rate of ~25-30%. Memarzadeh, S. & Berek, J. S., supra; Nunns, D. et al., *Obstet. Gynecol. Surv.* 55(12):746-51. Conversely, women diagnosed with early stage ovarian cancer enjoy considerably higher survival rates. Werness, B. A. & Eltabbakh, G. H., *Int'l. J. Gynecol. Pathol.* 20(1):48-63 (2001). Although our understanding of the etiology of ovarian cancer is incomplete, the results of extensive research in this area point to a combination of age, genetics, reproductive, and dietary/environmental factors. Age is a key risk factor in the development of ovarian cancer: while the risk for developing ovarian cancer before the age of 30 is slim, the incidence of ovarian cancer rises linearly between ages 30 to 50, increasing at a slower rate thereafter, with the highest incidence being among septagenarian women. Jeanne M. Schilder et al., *Hereditary Ovarian Cancer: Clinical Syndromes and Management*, in *Ovarian Cancer* 182 (Stephen C. Rubin & Gregory P. Sutton eds., 2d ed. 2001).

With respect to genetic factors, a family history of ovarian cancer is the most significant risk factor in the development of the disease, with that risk depending on the number of affected family members, the degree of their relationship to the woman, and which particular first degree relatives are affected by the disease. Id. Mutations in several genes have been associated with ovarian cancer, including BRCA1 and BRCA2, both of which play a key role in the development of breast cancer, as well as hMSH2 and hMLH1, both of which are associated with hereditary non-polyposis colon cancer. Katherine Y. Look, *Epidemiology, Etiology, and Screening of Ovarian Cancer*, in *Ovarian Cancer* 169, 171-73 (Stephen C. Rubin & Gregory P. Sutton eds., 2d ed. 2001). BRCA1, located on chromosome 17, and BRCA2, located on chromosome 13, are tumor suppressor genes implicated in DNA repair; mutations in these genes are linked to roughly 10% of ovarian cancers. Id. at 171-72; Schilder et al., supra at 185-86. hMSH2 and hMLH1 are associated with DNA mismatch repair, and are located on chromosomes 2 and 3, respectively; it has been reported that roughly 3% of hereditary ovarian carcinomas are due to mutations in these genes. Look, supra at 173; Schilder et al., supra at 184, 188-89.

Reproductive factors have also been associated with an increased or reduced risk of ovarian cancer. Late menopause, nulliparity, and early age at menarche have all been linked with an elevated risk of ovarian cancer. Schilder et al., supra at 182. One theory hypothesizes that these factors increase the number of ovulatory cycles over the course of a woman's life, leading to "incessant ovulation," which is thought to be the primary cause of mutations to the ovarian epithelium. Id; Laura J. Havrilesky & Andrew Berchuck, *Molecular Alterations in Sporadic Ovarian Cancer*, in *Ovarian Cancer* 25 (Stephen C. Rubin & Gregory P. Sutton eds., 2d ed. 2001). The mutations may be explained by the fact that ovulation results in the destruction and repair of that epithelium, necessitating increased cell division, thereby increasing the possibility that an undetected mutation will occur. Id. Support for this theory may be found in the fact that pregnancy, lactation, and the use of oral contraceptives, all of which suppress ovulation, confer a protective effect with respect to developing ovarian cancer. Id.

Among dietary/environmental factors, there would appear to be an association between high intake of animal fat or red meat and ovarian cancer, while the antioxidant Vitamin A, which prevents free radical formation and also assists in maintaining normal cellular differentiation, may offer a protective effect. Look, supra at 169. Reports have also associated asbestos and hydrous magnesium trisilicate (talc), the latter of which may be present in diaphragms and sanitary napkins. Id. at 169-70.

Current screening procedures for ovarian cancer, while of some utility, are quite limited in their diagnostic ability, a problem that is particularly acute at early stages of cancer progression when the disease is typically asymptomatic yet is most readily treatable. Walter J. Burdette, *Cancer: Etiology Diagnosis and Treatment* 166 (1998); Memarzadeh & Berek, supra; Runnebaum & Stickeler, supra; Werness & Eltabbakh, supra. Commonly used screening tests include biannual rectovaginal pelvic examination, radioimmunoassay to detect the CA-125 serum tumor marker, and transvaginal ultrasonography. Burdette, supra at 166.

Pelvic examination has failed to yield adequate numbers of early diagnoses, and the other methods are not sufficiently accurate. Id. One study reported that only 15% of patients who suffered from ovarian cancer were diagnosed with the disease at the time of their pelvic examination. Look, supra at 174. Moreover, the CA-125 test is prone to giving false positives in pre-menopausal women and has been reported to be of low predictive value in post-menopausal women. Id. at 174-75. Although transvaginal ultrasonography is now the preferred procedure for screening for ovarian cancer, it is unable to distinguish reliably between benign and malignant tumors, and also cannot locate primary peritoneal malignancies or ovarian cancer if the ovary size is normal. Schilder et al., supra at 194-95. While genetic testing for mutations of the BRCA1, BRCA2, hMSH2, and hMLH1 genes is now available, these tests may be too costly for some patients and may also yield false negative or indeterminate results. Schilder et al., supra at 191-94.

The staging of ovarian cancer, which is accomplished through surgical exploration, is crucial in determining the course of treatment and management of the disease. *AJCC Cancer Staging Handbook* 187 (Irvin D. Fleming et al. eds., 5th ed. 1998); Burdette, supra at 170; Memarzadeh & Berek, supra; Shridhar et al., supra. Staging is performed by reference to the classification system developed by the International Federation of Gynecology and Obstetrics. David H. Moore, *Primary Surgical Management of Early Epithelial Ovarian Carcinoma*, in *Ovarian Cancer* 203 (Stephen C. Rubin & Gregory P. Sutton eds., 2d ed. 2001); Fleming et al. eds., supra at 188. Stage I ovarian cancer is characterized by tumor growth that is limited to the ovaries and is comprised of three substages. Id. In substage IA, tumor growth is limited to one ovary, there is no tumor on the external surface of the ovary, the ovarian capsule is intact, and no malignant cells are present in ascites or peritoneal washings. Id. Substage IB is identical to A1, except that tumor growth is limited to both ovaries. Id. Substage IC refers to the presence of tumor growth limited to one or both ovaries, and also includes one or more of the following characteristics: capsule rupture, tumor growth on the surface of one or both ovaries, and malignant cells present in ascites or peritoneal washings. Id.

Stage II ovarian cancer refers to tumor growth involving one or both ovaries, along with pelvic extension. Id. Substage IIA involves extension and/or implants on the uterus and/or fallopian tubes, with no malignant cells in the ascites or peritoneal washings, while substage IIB involves extension into other pelvic organs and tissues, again with no malignant cells in the ascites or peritoneal washings. Id. Substage IIC involves pelvic extension as in IIA or IIB, but with malignant cells in the ascites or peritoneal washings. Id.

Stage III ovarian cancer involves tumor growth in one or both ovaries, with peritoneal metastasis beyond the pelvis confirmed by microscope and/or metastasis in the regional lymph nodes. Id. Substage IIIA is characterized by microscopic peritoneal metastasis outside the pelvis, with substage IIIB involving macroscopic peritoneal metastasis outside the pelvis 2 cm or less in greatest dimension. Id. Substage IIIC is identical to IIIB, except that the metastasis is greater than 2 cm in greatest dimension and may include regional lymph node metastasis. Id. Lastly, Stage IV refers to the presence distant metastasis, excluding peritoneal metastasis. Id.

While surgical staging is currently the benchmark for assessing the management and treatment of ovarian cancer, it suffers from considerable drawbacks, including the invasiveness of the procedure, the potential for complications, as well as the potential for inaccuracy. Moore, supra at 206-208, 213. In view of these limitations, attention has turned to developing alternative staging methodologies through understanding differential gene expression in various stages of ovarian cancer and by obtaining various biomarkers to help better assess the progression of the disease. Vartiainen, J. et al., *Int'l J. Cancer,* 95(5):313-16 (2001); Shridhar et al. supra; Baekelandt, M. et al., *J. Clin. Oncol.* 18(22):3775-81.

The treatment of ovarian cancer typically involves a multiprong attack, with surgical intervention serving as the foundation of treatment. Dennis S. Chi & William J. Hoskins, *Primary Surgical Management of Advanced Epithelial Ovarian Cancer,* in *Ovarian Cancer* 241 (Stephen C. Rubin & Gregory P. Sutton eds., 2d ed. 2001). For example, in the case of epithelial ovarian cancer, which accounts for ~90% of cases of ovarian cancer, treatment typically consists of: (1) cytoreductive surgery, including total abdominal hysterectomy, bilateral salpingo-oophorectomy, omentectomy, and lymphadenectomy, followed by (2) adjuvant chemotherapy with paclitaxel and either cisplatin or carboplatin. Eltabbakh, G. H. & Awtrey, C. S., *Expert Op. Pharmacother.* 2(10):109-24. Despite a clinical response rate of 80% to the adjuvant therapy, most patients experience tumor recurrence within three years of treatment. Id. Certain patients may undergo a second cytoreductive surgery and/or second-line chemotherapy. Memarzadeh & Berek, supra.

From the foregoing, it is clear that procedures used for detecting, diagnosing, monitoring, staging, prognosticating, and preventing the recurrence of ovarian cancer are of critical importance to the outcome of the patient. Moreover, current procedures, while helpful in each of these analyses, are limited by their specificity, sensitivity, invasiveness, and/or their cost. As such, highly specific and sensitive procedures that would operate by way of detecting novel markers in cells, tissues, or bodily fluids, with minimal invasiveness and at a reasonable cost, would be highly desirable.

Breast cancer, also referred to as mammary tumor cancer, is the second most common cancer among women, accounting for a third of the cancers diagnosed in the United States. One in nine women will develop breast cancer in her lifetime and about 192,000 new cases of breast cancer are diagnosed annually with about 42,000 deaths. Bevers, *Primary Prevention of Breast Cancer*, in *Breast Cancer,* 20-54 (Kelly K Hunt et al., ed., 2001); Kochanek et al., 49 *Nat'l. Vital Statistics Reports* 1, 14 (2001). Breast cancer is extremely rare in women younger than 20 and is very rare in women under 30. The incidence of breast cancer rises with age and becomes significant by age 50. White Non-Hispanic women have the highest incidence rate for breast cancer and Korean women have the lowest. Increased prevalence of the genetic mutations BRCA1 and BRCA2 that promote breast and other cancers are found in Ashkenazi Jews. African American women have the highest mortality rate for breast cancer among these same groups (31 per 100,000), while Chinese women have the lowest at 11 per 100,000. Although men can get breast cancer, this is extremely rare. In the United States it is estimated there will be 212,600 new cases of breast cancer and 40,200 deaths due to breast cancer in 2003. (American Cancer Society Website: cancer.org on the world wide web). With the exception of those cases with associated genetic factors, precise causes of breast cancer are not known.

In the treatment of breast cancer, there is considerable emphasis on detection and risk assessment because early and accurate staging of breast cancer has a significant impact on survival. For example, breast cancer detected at an early stage (stage T0, discussed below) has a five-year survival rate of 92%. Conversely, if the cancer is not detected until a late stage (i.e., stage T4 (IV)), the five-year survival rate is reduced to 13%. *AJCC Cancer Staging Handbook pp.* 164-65 (Irvin D. Fleming et al. eds., 5$^{th}$ ed. 1998). Some detection techniques, such as mammography and biopsy, involve increased discomfort, expense, and/or radiation, and are only prescribed only to patients with an increased risk of breast cancer.

Current methods for predicting or detecting breast cancer risk are not optimal. One method for predicting the relative risk of breast cancer is by examining a patient's risk factors and pursuing aggressive diagnostic and treatment regiments for high risk patients. A patient's risk of breast cancer has been positively associated with increasing age, nulliparity, family history of breast cancer, personal history of breast cancer, early menarche, late menopause, late age of first full term pregnancy, prior proliferative breast disease, irradiation of the breast at an early age and a personal history of malignancy. Lifestyle factors such as fat consumption, alcohol consumption, education, and socioeconomic status have also been associated with an increased incidence of breast cancer although a direct cause and effect relationship has not been established. While these risk factors are statistically significant, their weak association with breast cancer limited their usefulness. Most women who develop breast cancer have none of the risk factors listed above, other than the risk that comes with growing older. NIH Publication No. 00-1556 (2000).

Current screening methods for detecting cancer, such as breast self exam, ultrasound, and mammography have drawbacks that reduce their effectiveness or prevent their widespread adoption. Breast self exams, while useful, are unreliable for the detection of breast cancer in the initial stages where the tumor is small and difficult to detect by palpation. Ultrasound measurements require skilled operators at an increased expense. Mammography, while sensitive, is subject to over diagnosis in the detection of lesions that have questionable malignant potential. There is also the fear of the radiation used in mammography because prior chest radiation is a factor associated with an increase incidence of breast cancer.

At this time, there are no adequate methods of breast cancer prevention. The current methods of breast cancer prevention involve prophylactic mastectomy (mastectomy performed before cancer diagnosis) and chemoprevention (chemotherapy before cancer diagnosis) which are drastic measures that limit their adoption even among women with increased risk of breast cancer. Bevers, supra.

A number of genetic markers have been associated with breast cancer. Examples of these markers include carcinoembryonic antigen (CEA) (Mughal et al., *JAMA* 249:1881 (1983)), MUC-1 (Frische and Liu, *J. Clin. Ligand* 22:320 (2000)), HER-2/neu (Haris et al., *Proc. Am. Soc. Clin. Oncology* 15:A96 (1996)), uPA, PAI-1, LPA, LPC, RAK and BRCA (Esteva and Fritsche, *Serum and Tissue Markers for Breast Cancer*, in *Breast Cancer*, 286-308 (2001)). These markers have problems with limited sensitivity, low correlation, and false negatives which limit their use for initial diagnosis. For example, while the BRCA1 gene mutation is useful as an indicator of an increased risk for breast cancer, it has limited use in cancer diagnosis because only 6.2% of breast cancers are BRCA1 positive. Malone et al., *JAMA* 279:922 (1998). See also, Mewman et al., *JAMA* 279:915 (1998) (correlation of only 3.3%).

There are four primary classifications of breast cancer varying by the site of origin and the extent of disease development.

I. Ductal carcinoma in situ (DCIS): Malignant transformation of ductal epithelial cells that remain in their normal position. DCIS is a purely localized disease, incapable of metastasis.

II. Invasive ductal carcinoma (IDC): Malignancy of the ductal epithelial cells breaking through the basal membrane and into the supporting tissue of the breast. IDC may eventually spread elsewhere in the body.

III. Lobular carcinoma in situ (LCIS): Malignancy arising in a single lobule of the breast that fail to extend through the lobule wall, it generally remains localized.

IV. Infiltrating lobular carcinoma (ILC): Malignancy arising in a single lobule of the breast and invading directly through the lobule wall into adjacent tissues.

By virtue of its invasion beyond the lobule wall, ILC may penetrate lymphatics and blood vessels and spread to distant sites.

For purpose of determining prognosis and treatment, these four breast cancer types have been staged according to the size of the primary tumor (T), the involvement of lymph nodes (N), and the presence of metastasis (M). Although DCIS by definition represents localized stage I disease, the other forms of breast cancer may range from stage II to stage IV. There are additional prognostic factors that further serve to guide surgical and medical intervention. The most common ones are total number of lymph nodes involved, ER (estrogen receptor) status, Her2/neu receptor status and histologic grades.

Breast cancers are diagnosed into the appropriate stage categories recognizing that different treatments are more effective for different stages of cancer. Stage TX indicates that primary tumor cannot be assessed (i.e., tumor was removed or breast tissue was removed). Stage T0 is characterized by abnormalities such as hyperplasia but with no evidence of primary tumor. Stage Tis is characterized by carcinoma in situ, intraductal carcinoma, lobular carcinoma in situ, or Paget's disease of the nipple with no tumor. Stage T1 (I) is characterized as having a tumor of 2 cm or less in the greatest dimension. Within stage T1, Tmic indicates microinvasion of 0.1 cm or less, T1a indicates a tumor of between 0.1 to 0.5 cm, T1b indicates a tumor of between 0.5 to 1 cm, and T1c indicates tumors of between 1 cm to 2 cm. Stage T2 (II) is characterized by tumors from 2 cm to 5 cm in the greatest dimension. Tumors greater than 5 cm in size are classified as stage T3 (III). Stage T4 (IV) indicates a tumor of any size with extension to the chest wall or skin. Within stage T4, T4a indicates extension of the tumor to the chest wall, T4b indicates edema or ulceration of the skin of the breast or satellite skin nodules confined to the same breast, T4c indicates a combination of T4a and T4b, and T4d indicates inflammatory carcinoma. *AJCC Cancer Staging Handbook* pp. 159-70 (Irvin D. Fleming et al. eds., 5$^{th}$ ed. 1998). In addition to standard staging, breast tumors may be classified according to their estrogen receptor and progesterone receptor protein status. Fisher et al., *Breast Cancer Research and Treatment* 7:147 (1986). Additional pathological status, such as HER2/neu status may also be useful. Thor et al., *J. Nat'l. Cancer Inst.* 90:1346 (1998); Paik et al., *J. Nat'l. Cancer Inst.* 90:1361 (1998); Hutchins et al., *Proc. Am. Soc. Clin. Oncology* 17:A2 (1998); and Simpson et al., *J. Clin. Oncology* 18:2059 (2000).

In addition to the staging of the primary tumor, breast cancer metastases to regional lymph nodes may be staged. Stage NX indicates that the lymph nodes cannot be assessed (e.g., previously removed). Stage N0 indicates no regional lymph node metastasis. Stage N1 indicates metastasis to movable ipsilateral axillary lymph nodes. Stage N2 indicates metastasis to ipsilateral axillary lymph nodes fixed to one another or to other structures. Stage N3 indicates metastasis to ipsilateral internal mammary lymph nodes. Id.

Stage determination has potential prognostic value and provides criteria for designing optimal therapy. Simpson et al., *J. Clin. Oncology* 18:2059 (2000). Generally, pathological staging of breast cancer is preferable to clinical staging because the former gives a more accurate prognosis. However, clinical staging would be preferred if it were as accurate as pathological staging because it does not depend on an invasive procedure to obtain tissue for pathological evaluation. Staging of breast cancer would be improved by detecting new markers in cells, tissues, or bodily fluids which could differentiate between different stages of invasion. Progress in this field will allow more rapid and reliable method for treating breast cancer patients.

Treatment of breast cancer is generally decided after an accurate staging of the primary tumor. Primary treatment options include breast conserving therapy (lumpectomy, breast irradiation, and surgical staging of the axilla), and modified radical mastectomy. Additional treatments include chemotherapy, regional irradiation, and, in extreme cases, terminating estrogen production by ovarian ablation.

Until recently, the customary treatment for all breast cancer was mastectomy. Fonseca et al., *Annals of Internal Medicine* 127:1013 (1997). However, recent data indicate that less radical procedures may be equally effective, in terms of survival, for early stage breast cancer. Fisher et al., *J. of Clinical Oncology* 16:441 (1998). The treatment options for a patient with early stage breast cancer (i.e., stage Tis) may be breast-sparing surgery followed by localized radiation therapy at the breast. Alternatively, mastectomy optionally coupled with radiation or breast reconstruction may be employed. These treatment methods are equally effective in the early stages of breast cancer.

Patients with stage I and stage II breast cancer require surgery with chemotherapy and/or hormonal therapy. Surgery is of limited use in stage III and stage IV patients. Thus, these patients are better candidates for chemotherapy and radiation therapy with surgery limited to biopsy to permit initial staging or subsequent restaging because cancer is rarely curative at this stage of the disease. *AJCC Cancer Staging Handbook* 84, 164-65 (Irvin D. Fleming et al. eds., 5th ed. 1998).

In an effort to provide more treatment options to patients, efforts are underway to define an earlier stage of breast cancer with low recurrence which could be treated with lumpectomy without postoperative radiation treatment. While a number of attempts have been made to classify early stage breast cancer, no consensus recommendation on postoperative radiation treatment has been obtained from these studies. Page et al., *Cancer* 75:1219 (1995); Fisher et al., *Cancer* 75:1223 (1995); Silverstein et al., *Cancer* 77:2267 (1996).

As discussed above, each of the methods for diagnosing and staging ovarian, and breast cancer is limited by the technology employed. Accordingly, there is need for sensitive molecular and cellular markers for the detection of ovarian, and breast cancer as well as pancreatic cancer. There is a need for molecular markers for the accurate staging, including clinical and pathological staging, of ovarian, pancreatic or breast cancers to optimize treatment methods. Finally, there is a need for sensitive molecular and cellular markers to monitor the progress of cancer treatments, including markers that can detect recurrence of ovarian, pancreatic or breast cancers following remission.

The present invention provides alternative methods of treating ovarian, pancreatic or breast cancer that overcome the limitations of conventional therapeutic methods as well as offer additional advantages that will be apparent from the detailed description below.

Growth and metastasis of solid tumors are also dependent on angiogenesis. Folkman, J., 1986, *Cancer Research*, 46, 467-473; Folkman, J., 1989, *Journal of the National Cancer Institute*, 82, 4-6. It has been shown, for example, that tumors which enlarge to greater than 2 mm must obtain their own blood supply and do so by inducing the growth of new capillary blood vessels. Once these new blood vessels become embedded in the tumor, they provide a means for tumor cells to enter the circulation and metastasize to distant sites such as liver, lung or bone. Weidner, N., et al., 1991, *The New England Journal of Medicine*, 324(1), 1-8.

Angiogenesis, defined as the growth or sprouting of new blood vessels from existing vessels, is a complex process that primarily occurs during embryonic development. The process is distinct from vasculogenesis, in that the new endothelial cells lining the vessel arise from proliferation of existing cells, rather than differentiating from stem cells. The process is invasive and dependent upon proteolysis of the extracellular matrix (ECM), migration of new endothelial cells, and synthesis of new matrix components. Angiogenesis occurs during embryogenic development of the circulatory system; however, in adult humans, angiogenesis only occurs as a response to a pathological condition (except during the reproductive cycle in women).

Under normal physiological conditions in adults, angiogenesis takes place only in very restricted situations such as hair growth and wounding healing. Auerbach, W. and Auerbach, R., 1994, *Pharmacol Ther.* 63(3):265-3 11; Ribatti et al., 1991, *Haematologica* 76(4):3 11-20; Risau, 1997, *Nature* 386(6626):67 1-4. Angiogenesis progresses by a stimulus which results in the formation of a migrating column of endothelial cells. Proteolytic activity is focused at the advancing tip of this "vascular sprout", which breaks down the ECM sufficiently to permit the column of cells to infiltrate and migrate. Behind the advancing front, the endothelial cells differentiate and begin to adhere to each other, thus forming a new basement membrane. The cells then cease proliferation and finally define a lumen for the new arteriole or capillary.

Unregulated angiogenesis has gradually been recognized to be responsible for a wide range of disorders, including, but not limited to, cancer, cardiovascular disease, rheumatoid arthritis, psoriasis and diabetic retinopathy. Folkman, 1995, *Nat Med* 1(1):27-31; Isner, 1999, *Circulation* 99(13): 1653-5; Koch, 1998, *Arthritis Rheum* 41(6):951-62; Walsh, 1999, *Rheumatology* (Oxford) 38(2):103-12; Ware and Simons, 1997, *Nat Med* 3(2): 158-64.

Of particular interest is the observation that angiogenesis is required by solid tumors for their growth and metastases. Folkman, 1986 supra; Folkman 1990, *J Natl. Cancer Inst.*, 82(1) 4-6; Folkman, 1992, *Semin Cancer Biol* 3(2):65-71; Zetter, 1998, *Annu Rev Med* 49:407-24. A tumor usually begins as a single aberrant cell which can proliferate only to a size of a few cubic millimeters due to the distance from available capillary beds, and it can stay 'dormant' without further growth and dissemination for a long period of time. Some tumor cells then switch to the angiogenic phenotype to activate endothelial cells, which proliferate and mature into new capillary blood vessels. These newly formed blood vessels not only allow for continued growth of the primary tumor, but also for the dissemination and recolonization of metastatic tumor cells. The precise mechanisms that control the angiogenic switch is not well understood, but it is believed that neovascularization of tumor mass results from the net balance of a multitude of angiogenesis stimulators and inhibitors Folkman, 1995, supra.

One of the most potent angiogenesis inhibitors is endostatin identified by O'Reilly and Folkman. O'Reilly et al., 1997, Cell 88(2):277-85; O'Reilly et al., 1994, Cell 79(2):3 15-28. Its discovery was based on the phenomenon that certain primary tumors can inhibit the growth of distant metastases. O'Reilly and Folkman hypothesized that a primary tumor initiates angiogenesis by generating angiogenic stimulators in excess of inhibitors. However, angiogenic inhibitors, by virtue of their longer half life in the circulation, reach the site of a secondary tumor in excess of the stimulators. The net result is the growth of primary tumor and inhibition of secondary tumor. Endostatin is one of a growing list of such angiogenesis inhibitors produced by primary tumors. It is a proteolytic fragment of a larger protein: endostatin is a 20 kDa fragment of collagen XVIII (amino acid H1132-K1315 in murine collagen XVIII). Endostatin has been shown to specifically inhibit endothelial cell proliferation in vitro and block angiogenesis in vivo. More importantly, administration of endostatin to tumor-bearing mice leads to significant tumor regression, and no toxicity or drug resistance has been observed even after multiple treatment cycles. Boehm et al., 1997, Nature 390(6658):404-407. The fact that endostatin targets genetically stable endothelial cells and inhibits a variety of solid tumors makes it a very attractive candidate for anticancer therapy. Fidler and Ellis, 1994, Cell 79(2):185-8; Gastl et al., 1997, Oncology 54(3):177-84; Hinsbergh et al., 1999, Ann Oncol 10 Suppl 4:60-3. In addition, angiogenesis inhibitors have been shown to be more effective when combined with radiation and chemotherapeutic agents. Klement, 2000, J. Clin Invest, 105(8) R15-24. Browder, 2000, Cancer Res. 6-(7) 1878-86, Arap et al., 1998, Science 279(5349): 377-80; Mauceri et al., 1998, Nature 394(6690):287-91.

SUMMARY OF THE INVENTION

The present invention solves many needs in the art by providing nucleic acid molecules, polypeptides and antibodies thereto, variants and derivatives of the nucleic acids and polypeptides, and agonists and antagonists thereto that may be used to identify, diagnose, monitor, stage, image and treat ovarian cancer and/or non-cancerous disease states in ovarian; identify and monitor ovarian tissue; and identify and design agonists and antagonists of polypeptides of the invention. The invention also provides gene therapy, methods for producing transgenic animals and cells, and methods for producing engineered ovarian tissue for treatment and research.

One aspect of the present invention relates to nucleic acid molecules that are specific to ovarian cells, ovarian tissue and/or the ovarian organ. These ovarian specific nucleic acids (OSNAs) may be a naturally occurring cDNA, genomic DNA, RNA, or a fragment of one of these nucleic acids, or may be a non-naturally occurring nucleic acid molecule. If the OSNA is genomic DNA, then the OSNA is an ovarian specific gene (OSG). If the OSNA is RNA, then it is an ovarian specific transcript encoded by an OSG. Due to alternative splicing and transcriptional modification one OSG may encode for multiple ovarian specific RNAs. In a preferred embodiment, the nucleic acid molecule encodes a polypeptide that is specific to ovarian. More preferred is a nucleic acid molecule that encodes a polypeptide comprising an amino acid sequence of SEQ ID NO: 129-295. In another preferred embodiment, the nucleic acid molecule comprises a nucleic acid sequence of SEQ ID NO: 1-128. For the OSNA sequences listed herein, DEX0455_001.nt.1 corresponds to SEQ ID NO: 1. For sequences with multiple splice variants, the parent sequence DEX0455_001.nt.1, will be followed by DEX0455_001.nt.2, etc. for each splice variant. The sequences off the corresponding peptides are listed as DEX0455_001.aa.1, etc. For the mapping of all of the nucleotides and peptides, see the table in the Example 1 section below.

This aspect of the present invention also relates to nucleic acid molecules that selectively hybridize or exhibit substantial sequence similarity to nucleic acid molecules encoding an Ovarian Specific Protein (OSP), or that selectively hybridize or exhibit substantial sequence similarity to an OSNA. In one embodiment of the present invention the nucleic acid molecule comprises an allelic variant of a nucleic acid molecule encoding an OSP, or an allelic variant of an OSNA. In another embodiment, the nucleic acid molecule comprises a part of a nucleic acid sequence that encodes an OSP or a part of a nucleic acid sequence of an OSNA.

In addition, this aspect of the present invention relates to a nucleic acid molecule further comprising one or more expression control sequences controlling the transcription and/or translation of all or a part of an OSNA or the transcription and/or translation of a nucleic acid molecule that encodes all or a fragment of an OSP.

Another aspect of the present invention relates to vectors and/or host cells comprising a nucleic acid molecule of this invention. In a preferred embodiment, the nucleic acid molecule of the vector and/or host cell encodes all or a fragment of an OSP. In another preferred embodiment, the nucleic acid molecule of the vector and/or host cell comprises all or a part of an OSNA. Vectors and host cells of the present invention are useful in the recombinant production of polypeptides, particularly OSPs of the present invention.

Another aspect of the present invention relates to polypeptides encoded by a nucleic acid molecule of this invention. The polypeptide may comprise either a fragment or a full-length protein. In a preferred embodiment, the polypeptide is an OSP. However, this aspect of the present invention also relates to mutant proteins (muteins) of OSPs, fusion proteins of which a portion is an OSP, and proteins and polypeptides encoded by allelic variants of an OSNA as provided herein.

A further aspect of the present invention is a novel splice variant which encodes an amino acid sequence that provides a novel region to be targeted for the generation of reagents that can be used in the detection and/or treatment of cancer. The novel amino acid sequence may lead to a unique protein structure, protein subcellular localization, biochemical processing or function. This information can be used to directly or indirectly facilitate the generation of additional or novel therapeutics or diagnostics. The nucleotide sequence in this novel splice variant can be used as a nucleic acid probe for the diagnosis and/or treatment of cancer.

Another aspect of the present invention relates to antibodies and other binders that specifically bind to a polypeptide of the instant invention. Accordingly antibodies or binders of the present invention specifically bind to OSPs, muteins, fusion proteins, and/or homologous proteins or polypeptides encoded by allelic variants of an OSNA as provided herein.

Another aspect of the present invention relates to agonists and antagonists of the nucleic acid molecules and polypeptides of this invention. The agonists and antagonists of the instant invention may be used to treat ovarian cancer and non-cancerous disease states in ovarian and to produce engineered ovarian tissue.

Another aspect of the present invention relates to methods for using the nucleic acid molecules to detect or amplify nucleic acid molecules that have similar or identical nucleic acid sequences compared to the nucleic acid molecules described herein. Such methods are useful in identifying, diagnosing, monitoring, staging, imaging and treating ovarian cancer and/or non-cancerous disease states in ovarian. Such methods are also useful in identifying and/or monitoring ovarian tissue. In addition, measurement of levels of one or more of the nucleic acid molecules of this invention may be useful as a diagnostic as part of a panel in combination with known other markers, particularly those described in the ovarian cancer background section above.

Another aspect of the present invention relates to use of the nucleic acid molecules of this invention in gene therapy, for producing transgenic animals and cells, and for producing engineered ovarian tissue for treatment and research.

Another aspect of the present invention relates to methods for detecting polypeptides of this invention, preferably using antibodies thereto. Such methods are useful to identify, diagnose, monitor, stage, image and treat ovarian cancer and non-cancerous disease states in ovarian. In addition, measurement of levels of one or more of the polypeptides of this invention may be useful to identify, diagnose, monitor, stage, and/or image ovarian cancer in combination with known other markers, particularly those described in the ovarian cancer background section above. The polypeptides of the present invention can also be used to identify and/or monitor ovarian tissue, and to produce engineered ovarian tissue.

Yet another aspect of the present invention relates to a computer readable means of storing the nucleic acid and amino acid sequences of the invention. The records of the computer readable means can be accessed for reading and displaying of sequences for comparison, alignment and ordering of the sequences of the invention to other sequences. In addition, the computer records regarding the nucleic acid and/or amino acid sequences and/or measurements of their levels may be used alone or in combination with other markers to diagnose ovarian related diseases.

BRIEF DESCRIPTION OF THE FIGURES

FIG. 1 is a nucleotide sequence alignment which shows regions of similarity and difference between DEX0455_049.nt.5 (SEQ ID NO:96; EpCAM) and DEX0455_049.nt.1 (SEQ ID NO:92; Ovr232);

FIG. 2 is an amino acid sequence alignment which shows regions of similarity and difference between DEX0455_049.aa.5 (SEQ ID NO:255; EpCAM) and DEX0455_049.aa.1 (SEQ ID NO:251; Ovr232);

FIG. 3 is a nucleotide sequence alignment which shows regions of similarity and difference between DEX0455_049.nt.5 (SEQ ID NO:96; EpCAM) and DEX0455_049.nt.2 (SEQ ID NO:93; Ovr232v1);

FIG. 4 is an amino acid sequence alignment which shows regions of similarity and difference between DEX0455_049.aa.5 (SEQ ID NO:255; EpCAM) and DEX0455_049.aa.2 (SEQ ID NO:252; Ovr232v1);

FIG. 5 is a nucleotide sequence alignment which shows regions of similarity and difference between DEX0455_049.nt.5 (SEQ ID NO:96; EpCAM) and DEX0455_049.nt.3 (SEQ ID NO:94; Ovr232v2);

FIG. 6 is an amino acid sequence alignment which shows regions of similarity and difference between DEX0455_049.aa.5 (SEQ ID NO:255; EpCAM) and DEX0455_049.aa.3 (SEQ ID NO:253; Ovr232v2);

FIG. 7 is a nucleotide sequence alignment which shows regions of similarity and difference between DEX0455_049.nt.5 (SEQ ID NO:96; EpCAM) and DEX0455_049.nt.4 (SEQ ID NO:95; Ovr232v3);

FIG. 8 is an amino acid sequence alignment which shows regions of similarity and difference between DEX0455_049.aa.5 (SEQ ID NO:255; EpCAM) and DEX0455_049.aa.4 (SEQ ID NO:254; Ovr232v3);

FIG. 9 is a nucleotide sequence alignment which shows regions of similarity and difference between DEX0455_051.nt.1 (SEQ ID NO:98; Ovr107) and DEX0455_051.nt.2 (SEQ ID NO:99);

FIG. 10 is an amino acid sequence alignment which shows regions of similarity and difference between DEX0455_051.aa.1 (SEQ ID NO:258; Ovr107) and DEX0455_051.aa.3 (SEQ ID NO:260);

FIG. 11 is an amino acid sequence alignment which shows regions of similarity and difference between DEX0455_051.aa.1 (SEQ ID NO:258; Ovr107) and DEX0455_051.aa.2 (SEQ ID NO:259);

FIG. 12 is a nucleotide sequence alignment which shows regions of similarity and difference between DEX0455_051.nt.1 (SEQ ID NO:98; Ovr107) and DEX0455_051.nt.3 (SEQ ID NO:100);

FIG. 13 is a nucleotide sequence alignment which shows regions of similarity and difference between DEX0455_051.nt.1 (SEQ ID NO:98; Ovr107) and DEX0455_051.nt.4 (SEQ ID NO:101);

FIG. 14 is a nucleotide sequence alignment which shows regions of similarity and difference between DEX0455_051.nt.1 (SEQ ID NO:98; Ovr107) and DEX0455_051.nt.5 (SEQ ID NO:102);

FIG. 15 is a nucleotide sequence alignment which shows regions of similarity and difference between DEX0455_051.nt.1 (SEQ ID NO:98; Ovr107) and DEX0455_051.nt.6 (SEQ ID NO:103; Ovr107v4);

FIG. 16 is a nucleotide sequence alignment which shows regions of similarity and difference between DEX0455_053.nt.1 (SEQ ID NO:108; Ovr110) and DEX0455_053.nt.2 (SEQ ID NO:109; Ovr110v1);

FIG. 17 is an amino acid sequence alignment which shows regions of similarity and difference between DEX0455_053.aa.1 (SEQ ID NO:268; Ovr110) and DEX0455_053.aa.2 (SEQ ID NO:269);

FIG. 18 is an amino acid sequence alignment which shows regions of similarity and difference between DEX0455_053.aa.1 (SEQ ID NO:268; Ovr110) and DEX0455_053.aa.3 (SEQ ID NO:270).

DETAILED DESCRIPTION OF THE INVENTION

Definitions and General Techniques

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present invention are generally performed according to conventional methods well known in the art and as described in various general and more specific references that are cited and discussed throughout the present specification unless otherwise indicated. See, e.g., Sambrook et al., *Molecular Cloning: A Laboratory Manual,* 2d ed., Cold Spring Harbor Laboratory Press (1989) and Sambrook et al., *Molecular Cloning: A*

Laboratory Manual, 3d ed., Cold Spring Harbor Press (2001); Ausubel et al., Current Protocols in Molecular Biology, Greene Publishing Associates (1992, and Supplements to 2000); Ausubel et al., Short Protocols in Molecular Biology: A Compendium of Methods from Current Protocols in Molecular Biology—4$^{th}$ Ed., Wiley & Sons (1999); Harlow and Lane, Antibodies: A Laboratory Manual, Cold Spring Harbor Laboratory Press (1990); and Harlow and Lane, Using Antibodies: A Laboratory Manual, Cold Spring Harbor Laboratory Press (1999).

Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

The following terms, unless otherwise indicated, shall be understood to have the following meanings:

A "nucleic acid molecule" of this invention refers to a polymeric form of nucleotides and includes both sense and antisense strands of RNA, cDNA, genomic DNA, and synthetic forms and mixed polymers of the above. A nucleotide refers to a ribonucleotide, deoxynucleotide or a modified form of either type of nucleotide. A "nucleic acid molecule" as used herein is synonymous with "nucleic acid" and "polynucleotide." The term "nucleic acid molecule" usually refers to a molecule of at least 10 bases in length, unless otherwise specified. The term includes single- and double-stranded forms of DNA. In addition, a polynucleotide may include either or both naturally occurring and modified nucleotides linked together by naturally occurring and/or non-naturally occurring nucleotide linkages.

Nucleotides are represented by single letter symbols in nucleic acid molecule sequences. The following table lists symbols identifying nucleotides or groups of nucleotides which may occupy the symbol position on a nucleic acid molecule. See Nomenclature Committee of the International Union of Biochemistry (NC-IUB), Nomenclature for incompletely specified bases in nucleic acid sequences, Recommendations 1984., Eur J Biochem. 150(1):1-5 (1985).

| Symbol | Meaning | Group/Origin of Designation | Complementary Symbol |
|---|---|---|---|
| a | a | Adenine | t/u |
| g | g | Guanine | c |
| c | c | Cytosine | g |
| t | t | Thymine | a |
| u | u | Uracil | a |
| r | g or a | puRine | y |
| y | t/u or c | pYrimidine | r |
| m | a or c | aMino | k |
| k | g or t/u | Keto | m |
| s | g or c | Strong interactions 3H-bonds | w |
| w | a or t/u | Weak interactions 2H-bonds | s |
| b | g or c or t/u | not a | v |
| d | a or g or t/u | not c | h |
| h | a or c or t/u | not g | d |
| v | a or g or c | not t, not u | b |
| n | a or g or c or t/u, unknown, or other | aNy | n |

The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) The term "nucleic acid molecule" also includes any topological conformation, including single-stranded, double-stranded, partially duplexed, triplexed, hairpinned, circular and padlocked conformations. Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule.

A "gene" is defined as a nucleic acid molecule that comprises a nucleic acid sequence that encodes a polypeptide and the expression control sequences that surround the nucleic acid sequence that encodes the polypeptide. For instance, a gene may comprise a promoter, one or more enhancers, a nucleic acid sequence that encodes a polypeptide, downstream regulatory sequences and, possibly, other nucleic acid sequences involved in regulation of the expression of an RNA. As is well known in the art, eukaryotic genes usually contain both exons and introns. The term "exon" refers to a nucleic acid sequence found in genomic DNA that is bioinformatically predicted and/or experimentally confirmed to contribute contiguous sequence to a mature mRNA transcript. The term "intron" refers to a nucleic acid sequence found in genomic DNA that is predicted and/or confirmed to not contribute to a mature mRNA transcript, but rather to be "spliced out" during processing of the transcript.

A nucleic acid molecule or polypeptide is "derived" from a particular species if the nucleic acid molecule or polypeptide has been isolated from the particular species, or if the nucleic acid molecule or polypeptide is homologous to a nucleic acid molecule or polypeptide isolated from a particular species.

An "isolated" or "substantially pure" nucleic acid or polynucleotide (e.g., an RNA, DNA or a mixed polymer) is one which is substantially separated from other cellular components that naturally accompany the native polynucleotide in its natural host cell, e.g., ribosomes, polymerases, or genomic sequences with which it is naturally associated. The term embraces a nucleic acid or polynucleotide that (1) has been removed from its naturally occurring environment, (2) is not associated with all or a portion of a polynucleotide in which the "isolated polynucleotide" is found in nature, (3) is operatively linked to a polynucleotide which it is not linked to in nature, (4) does not occur in nature as part of a larger sequence or (5) includes nucleotides or internucleoside bonds that are not found in nature. The term "isolated" or "substantially pure" also can be used in reference to recombinant or cloned DNA isolates, chemically synthesized polynucleotide analogs, or polynucleotide analogs that are biologically synthesized by heterologous systems. The term "isolated nucleic acid molecule" includes nucleic acid molecules that are integrated into a host cell chromosome at a heterologous site, recombinant fusions of a native fragment to a heterologous sequence, recombinant vectors present as episomes or as integrated into a host cell chromosome.

A "part" of a nucleic acid molecule refers to a nucleic acid molecule that comprises a partial contiguous sequence of at least 10 bases of the reference nucleic acid molecule. Preferably, a part comprises at least 15 to 20 bases of a reference nucleic acid molecule. In theory, a nucleic acid sequence of 17 nucleotides is of sufficient length to occur at random less frequently than once in the three gigabase human genome, and thus provides a nucleic acid probe that can uniquely identify the reference sequence in a nucleic acid mixture of genomic complexity. A preferred part is one that comprises a nucleic acid sequence that can encode at least 6 contiguous amino acid sequences (fragments of at least 18 nucleotides) because they are useful in directing the expression or synthesis of peptides that are useful in mapping the epitopes of the polypeptide encoded by the reference nucleic acid. See, e.g., Geysen et al., *Proc. Natl. Acad. Sci. USA* 81:3998-4002 (1984); and U.S. Pat. Nos. 4,708,871 and 5,595,915, the disclosures of which are incorporated herein by reference in their entireties. A part may also comprise at least 25, 30, 35 or 40 nucleotides of a reference nucleic acid molecule, or at least 50, 60, 70, 80, 90, 100, 150, 200, 250, 300, 350, 400 or 500 nucleotides of a reference nucleic acid molecule. A part of a nucleic acid molecule may comprise no other nucleic acid sequences. Alternatively, a part of a nucleic acid may comprise other nucleic acid sequences from other nucleic acid molecules.

The term "oligonucleotide" refers to a nucleic acid molecule generally comprising a length of 200 bases or fewer. The term often refers to single-stranded deoxyribonucleotides, but it can refer as well to single- or double-stranded ribonucleotides, RNA:DNA hybrids and double-stranded DNAs, among others. Preferably, oligonucleotides are 10 to 60 bases in length and most preferably 12, 13, 14, 15, 16, 17, 18, 19 or 20 bases in length. Other preferred oligonucleotides are 25, 30, 35, 40, 45, 50, 55 or 60 bases in length. Oligonucleotides may be single-stranded, e.g. for use as probes or primers, or may be double-stranded, e.g. for use in the construction of a mutant gene. Oligonucleotides of the invention can be either sense or antisense oligonucleotides. An oligonucleotide can be derivatized or modified as discussed above for nucleic acid molecules.

Oligonucleotides, such as single-stranded DNA probe oligonucleotides, often are synthesized by chemical methods, such as those implemented on automated oligonucleotide synthesizers. However, oligonucleotides can be made by a variety of other methods, including in vitro recombinant DNA-mediated techniques and by expression of DNAs in cells and organisms. Initially, chemically synthesized DNAs typically are obtained without a 5' phosphate. The 5' ends of such oligonucleotides are not substrates for phosphodiester bond formation by ligation reactions that employ DNA ligases typically used to form recombinant DNA molecules. Where ligation of such oligonucleotides is desired, a phosphate can be added by standard techniques, such as those that employ a kinase and ATP. The 3' end of a chemically synthesized oligonucleotide generally has a free hydroxyl group and, in the presence of a ligase, such as T4 DNA ligase, readily will form a phosphodiester bond with a 5' phosphate of another polynucleotide, such as another oligonucleotide. As is well known, this reaction can be prevented selectively, where desired, by removing the 5' phosphates of the other polynucleotide(s) prior to ligation.

The term "naturally occurring nucleotide" referred to herein includes naturally occurring deoxyribonucleotides and ribonucleotides. The term "modified nucleotides" referred to herein includes nucleotides with modified or substituted sugar groups and the like. The term "nucleotide linkages" referred to herein includes nucleotide linkages such as phosphorothioate, phosphorodithioate, phosphoroselenoate, phosphorodiselenoate, phosphoroanilothioate, phoshoraniladate, phosphoroamidate, and the like. See e.g., LaPlanche et al. *Nucl. Acids Res.* 14:9081-9093 (1986); Stein et al. *Nucl. Acids Res.* 16:3209-3221 (1988); Zon et al. *Anti-Cancer Drug Design* 6:539-568 (1991); Zon et al., in Eckstein (ed.) *Oligonucleotides and Analogues: A Practical Approach*, pp. 87-108, Oxford University Press (1991); Uhlmann and Peyman *Chemical Reviews* 90:543 (1990), and U.S. Pat. No. 5,151,510, the disclosure of which is hereby incorporated by reference in its entirety.

Unless specified otherwise, the left hand end of a polynucleotide sequence in sense orientation is the 5' end and the right hand end of the sequence is the 3' end. In addition, the left hand direction of a polynucleotide sequence in sense orientation is referred to as the 5' direction, while the right hand direction of the polynucleotide sequence is referred to as the 3' direction. Further, unless otherwise indicated, each nucleotide sequence is set forth herein as a sequence of deoxyribonucleotides. It is intended, however, that the given sequence be interpreted as would be appropriate to the polynucleotide composition: for example, if the isolated nucleic acid is composed of RNA, the given sequence intends ribonucleotides, with uridine substituted for thymidine.

The term "allelic variant" refers to one of two or more alternative naturally occurring forms of a gene, wherein each gene possesses a unique nucleotide sequence. In a preferred embodiment, different alleles of a given gene have similar or identical biological properties.

The term "percent sequence identity" in the context of nucleic acid sequences refers to the residues in two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32 nucleotides, and preferably at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA, which includes, e.g., the programs FASTA2 and FASTA3, provides alignments and percent sequence identity of the regions of the best overlap between the query and search sequences (Pearson, *Methods Enzymol.* 183: 63-98 (1990); Pearson, *Methods Mol. Biol.* 132: 185-219 (2000); Pearson, *Methods Enzymol.* 266: 227-258 (1996); Pearson, *J. Mol. Biol.* 276: 71-84 (1998)). Unless otherwise specified, default parameters for a particular program or algorithm are used. For instance, percent sequence identity between nucleic acid sequences can be determined using FASTA with its default parameters (a word size of 6 and the NOPAM factor for the scoring matrix) or using Gap with its default parameters as provided in GCG Version 6.1.

A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for antisense therapy, double-stranded RNA (dsRNA) inhibition (RNAi), combination of triplex and antisense, hybridization probes and PCR primers.

In the molecular biology art, researchers use the terms "percent sequence identity", "percent sequence similarity"

and "percent sequence homology" interchangeably. In this application, these terms shall have the same meaning with respect to nucleic acid sequences only.

The term "substantial similarity" or "substantial sequence similarity," when referring to a nucleic acid or fragment thereof, indicates that, when optimally aligned with appropriate nucleotide insertions or deletions with another nucleic acid (or its complementary strand), there is nucleotide sequence identity in at least about 50%, more preferably 60% of the nucleotide bases, usually at least about 70%, more usually at least about 80%, preferably at least about 90%, and more preferably at least about 95-98% of the nucleotide bases, as measured by any well known algorithm of sequence identity, such as FASTA, BLAST or Gap, as discussed above.

Alternatively, substantial similarity exists between a first and second nucleic acid sequence when the first nucleic acid sequence or fragment thereof hybridizes to an antisense strand of the second nucleic acid, under selective hybridization conditions. Typically, selective hybridization will occur between the first nucleic acid sequence and an antisense strand of the second nucleic acid sequence when there is at least about 55% sequence identity between the first and second nucleic acid sequences—preferably at least about 65%, more preferably at least about 75%, and most preferably at least about 90%—over a stretch of at least about 14 nucleotides, more preferably at least 17 nucleotides, even more preferably at least 20, 25, 30, 35, 40, 50, 60, 70, 80, 90 or 100 nucleotides.

Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. "Stringent hybridization conditions" and "stringent wash conditions" in the context of nucleic acid hybridization experiments depend upon a number of different physical parameters. The most important parameters include temperature of hybridization, base composition of the nucleic acids, salt concentration and length of the nucleic acid. One having ordinary skill in the art knows how to vary these parameters to achieve a particular stringency of hybridization. In general, "stringent hybridization" is performed at about 25° C. below the thermal melting point ($T_m$) for the specific DNA hybrid under a particular set of conditions. "Stringent washing" is performed at temperatures about 5° C. lower than the $T_m$ for the specific DNA hybrid under a particular set of conditions. The $T_m$ is the temperature at which 50% of the target sequence hybridizes to a perfectly matched probe. See Sambrook (1989), supra, p. 9.51.

The $T_m$ for a particular DNA-DNA hybrid can be estimated by the formula:

$$T_m=81.5° C.+16.6(\log_{10}[Na^+])+0.41(\text{fraction } G+C)-0.63(\% \text{ formamide})-(600/l)$$

where l is the length of the hybrid in base pairs.

The $T_m$ for a particular RNA-RNA hybrid can be estimated by the formula:

$$T_m=79.8° C.+18.5(\log_{10}[Na^+])+0.58(\text{fraction } G+C)+11.8(\text{fraction } G+C)^2-0.35(\% \text{ formamide})-(820/l).$$

The $T_m$ for a particular RNA-DNA hybrid can be estimated by the formula:

$$T_m=79.8° C.+18.5(\log_{10}[Na^+])+0.58(\text{fraction } G+C)+11.8(\text{fraction } G+C)^2-0.50(\% \text{ formamide})-(820/l).$$

In general, the $T_m$ decreases by 1-1.5° C. for each 1% of mismatch between two nucleic acid sequences. Thus, one having ordinary skill in the art can alter hybridization and/or washing conditions to obtain sequences that have higher or lower degrees of sequence identity to the target nucleic acid. For instance, to obtain hybridizing nucleic acids that contain up to 10% mismatch from the target nucleic acid sequence, 10-15° C. would be subtracted from the calculated $T_m$ of a perfectly matched hybrid, and then the hybridization and washing temperatures adjusted accordingly. Probe sequences may also hybridize specifically to duplex DNA under certain conditions to form triplex or other higher order DNA complexes. The preparation of such probes and suitable hybridization conditions are well known in the art.

An example of stringent hybridization conditions for hybridization of complementary nucleic acid sequences having more than 100 complementary residues on a filter in a Southern or Northern blot or for screening a library is 50% formamide/6×SSC at 42° C. for at least ten hours and preferably overnight (approximately 16 hours). Another example of stringent hybridization conditions is 6×SSC at 68° C. without formamide for at least ten hours and preferably overnight. An example of moderate stringency hybridization conditions is 6×SSC at 55° C. without formamide for at least ten hours and preferably overnight. An example of low stringency hybridization conditions for hybridization of complementary nucleic acid sequences having more than 100 complementary residues on a filter in a Southern or northern blot or for screening a library is 6×SSC at 42° C. for at least ten hours. Hybridization conditions to identify nucleic acid sequences that are similar but not identical can be identified by experimentally changing the hybridization temperature from 68° C. to 42° C. while keeping the salt concentration constant (6×SSC), or keeping the hybridization temperature and salt concentration constant (e.g. 42° C. and 6×SSC) and varying the formamide concentration from 50% to 0%. Hybridization buffers may also include blocking agents to lower background. These agents are well known in the art. See Sambrook et al. (1989), supra, pages 8.46 and 9.46-9.58. See also Ausubel (1992), supra, Ausubel (1999), supra, and Sambrook (2001), supra.

Wash conditions also can be altered to change stringency conditions. An example of stringent wash conditions is a 0.2×SSC wash at 65° C. for 15 minutes (see Sambrook (1989), supra, for SSC buffer). Often the high stringency wash is preceded by a low stringency wash to remove excess probe. An exemplary medium stringency wash for duplex DNA of more than 100 base pairs is 1×SSC at 45° C. for 15 minutes. An exemplary low stringency wash for such a duplex is 4×SSC at 40° C. for 15 minutes. In general, signal-to-noise ratio of 2× or higher than that observed for an unrelated probe in the particular hybridization assay indicates detection of a specific hybridization.

As defined herein, nucleic acids that do not hybridize to each other under stringent conditions are still substantially similar to one another if they encode polypeptides that are substantially identical to each other. This occurs, for example, when a nucleic acid is created synthetically or recombinantly using a high codon degeneracy as permitted by the redundancy of the genetic code.

Hybridization conditions for nucleic acid molecules that are shorter than 100 nucleotides in length (e.g., for oligonucleotide probes) may be calculated by the formula:

$$T_m=81.5° C.+16.6(\log_{10}[Na^+])+0.41(\text{fraction } G+C)-(600/N),$$

wherein N is change length and the [Na⁺] is 1 M or less. See Sambrook (1989), supra, p. 11.46. For hybridization of probes shorter than 100 nucleotides, hybridization is usually performed under stringent conditions (5-10° C. below the $T_m$) using high concentrations (0.1-1.0 pmol/ml) of probe. Id. at p. 11.45. Determination of hybridization using mismatched probes, pools of degenerate probes or "guessmers," as well as hybridization solutions and methods for empirically determining hybridization conditions are well known in the art. See, e.g., Ausubel (1999), supra; Sambrook (1989), supra, pp. 11.45-11.57.

The term "digestion" or "digestion of DNA" refers to catalytic cleavage of the DNA with a restriction enzyme that acts only at certain sequences in the DNA. The various restriction enzymes referred to herein are commercially available and their reaction conditions, cofactors and other requirements for use are known and routine to the skilled artisan. For analytical purposes, typically, 1 μg of plasmid or DNA fragment is digested with about 2 units of enzyme in about 20 μl of reaction buffer. For the purpose of isolating DNA fragments for plasmid construction, typically 5 to 50 μg of DNA are digested with 20 to 250 units of enzyme in proportionately larger volumes. Appropriate buffers and substrate amounts for particular restriction enzymes are described in standard laboratory manuals, such as those referenced below, and are specified by commercial suppliers. Incubation times of about 1 hour at 37° C. are ordinarily used, but conditions may vary in accordance with standard procedures, the supplier's instructions and the particulars of the reaction. After digestion, reactions may be analyzed, and fragments may be purified by electrophoresis through an agarose or polyacrylamide gel, using well known methods that are routine for those skilled in the art.

The term "ligation" refers to the process of forming phosphodiester bonds between two or more polynucleotides, which most often are double-stranded DNAs. Techniques for ligation are well known to the art and protocols for ligation are described in standard laboratory manuals and references, such as, e.g., Sambrook (1989), supra.

Genome-derived "single exon probes," are probes that comprise at least part of an exon ("reference exon") and can hybridize detectably under high stringency conditions to transcript-derived nucleic acids that include the reference exon but do not hybridize detectably under high stringency conditions to nucleic acids that lack the reference exon. Single exon probes typically further comprise, contiguous to a first end of the exon portion, a first intronic and/or intergenic sequence that is identically contiguous to the exon in the genome, and may contain a second intronic and/or intergenic sequence that is identically contiguous to the exon in the genome. The minimum length of genome-derived single exon probes is defined by the requirement that the exonic portion be of sufficient length to hybridize under high stringency conditions to transcript-derived nucleic acids, as discussed above. The maximum length of genome-derived single exon probes is defined by the requirement that the probes contain portions of no more than one exon. The single exon probes may contain priming sequences not found in contiguity with the rest of the probe sequence in the genome, which priming sequences are useful for PCR and other amplification-based technologies. In another aspect, the invention is directed to single exon probes based on the OSNAs disclosed herein.

In one embodiment, the term "microarray" refers to a "nucleic acid microarray" having a substrate-bound plurality of nucleic acids, hybridization to each of the plurality of bound nucleic acids being separately detectable. The substrate can be solid or porous, planar or non-planar, unitary or distributed. Nucleic acid microarrays include all the devices so called in Schena (ed.), *DNA Microarrays: A Practical Approach (Practical Approach Series)*, Oxford University Press (1999); *Nature Genet.* 21(1) (suppl.): 1-60 (1999); Schena (ed.), *Microarray Biochip: Tools and Technology*, Eaton Publishing Company/BioTechniques Books Division (2000). Additionally, these nucleic acid microarrays include a substrate-bound plurality of nucleic acids in which the plurality of nucleic acids are disposed on a plurality of beads, rather than on a unitary planar substrate, as is described, inter alia, in Brenner et al., *Proc. Natl. Acad. Sci. USA* 97(4): 1665-1670 (2000). Examples of nucleic acid microarrays may be found in U.S. Pat. Nos. 6,391,623, 6,383,754, 6,383,749, 6,380,377, 6,379,897, 6,376,191, 6,372,431, 6,351,712 6,344,316, 6,316,193, 6,312,906, 6,309,828, 6,309,824, 6,306,643, 6,300,063, 6,287,850, 6,284,497, 6,284,465, 6,280,954, 6,262,216, 6,251,601, 6,245,518, 6,263,287, 6,251,601, 6,238,866, 6,228,575, 6,214,587, 6,203,989, 6,171,797, 6,103,474, 6,083,726, 6,054,274, 6,040,138, 6,083,726, 6,004,755, 6,001,309, 5,958,342, 5,952,180, 5,936,731, 5,843,655, 5,814,454, 5,837,196, 5,436,327, 5,412,087, and 5,405,783, the disclosures of which are incorporated herein by reference in their entireties.

In an alternative embodiment, a "microarray" may also refer to a "peptide microarray" or "protein microarray" having a substrate-bound collection or plurality of polypeptides, the binding to each of the plurality of bound polypeptides being separately detectable. Alternatively, the peptide microarray may have a plurality of binders, including but not limited to monoclonal antibodies, polyclonal antibodies, phage display binders, yeast 2 hybrid binders, and aptamers, which can specifically detect the binding of the polypeptides of this invention. The array may be based on autoantibody detection to the polypeptides of this invention, see Robinson et al., *Nature Medicine* 8(3):295-301 (2002). Examples of peptide arrays may be found in WO 02/31463, WO 02/25288, WO 01/94946, WO 01/88162, WO 01/68671, WO 01/57259, WO 00/61806, WO 00/54046, WO 00/47774, WO 99/40434, WO 99/39210, and WO 97/42507 and U.S. Pat. Nos. 6,268, 210, 5,766,960, and 5,143,854, the disclosures of which are incorporated herein by reference in their entireties.

In addition, determination of the levels of the OSNA or OSP may be made in a multiplex manner using techniques described in WO 02/29109, WO 02/24959, WO 01/83502, WO01/73113, WO 01/59432, WO 01/57269, and WO 99/67641, the disclosures of which are incorporated herein by reference in their entireties.

The term "mutant", "mutated", or "mutation" when applied to nucleic acid sequences means that nucleotides in a nucleic acid sequence may be inserted, deleted or changed compared to a reference nucleic acid sequence. A single alteration may be made at a locus (a point mutation) or multiple nucleotides may be inserted, deleted or changed at a single locus. In addition, one or more alterations may be made at any number of loci within a nucleic acid sequence. In a preferred embodiment of the present invention, the nucleic acid sequence is the wild type nucleic acid sequence encoding an OSP or is an OSNA. The nucleic acid sequence may be mutated by any method known in the art including those mutagenesis techniques described infra.

The term "error-prone PCR" refers to a process for performing PCR under conditions where the copying fidelity of the DNA polymerase is low, such that a high rate of point mutations is obtained along the entire length of the PCR product. See, e.g., Leung et al., *Technique* 1: 11-15 (1989) and Caldwell et al., *PCR Methods Applic.* 2: 28-33 (1992).

The term "oligonucleotide-directed mutagenesis" refers to a process which enables the generation of site-specific mutations in any cloned DNA segment of interest. See, e.g., Reidhaar-Olson et al., *Science* 241: 53-57 (1988).

The term "assembly PCR" refers to a process which involves the assembly of a PCR product from a mixture of small DNA fragments. A large number of different PCR reactions occur in parallel in the same vial, with the products of one reaction priming the products of another reaction.

The term "sexual PCR mutagenesis" or "DNA shuffling" refers to a method of error-prone PCR coupled with forced homologous recombination between DNA molecules of different but highly related DNA sequence in vitro, caused by random fragmentation of the DNA molecule based on sequence similarity, followed by fixation of the crossover by primer extension in an error-prone PCR reaction. See, e.g., Stemmer, *Proc. Natl. Acad. Sci. U.S.A.* 91: 10747-10751 (1994). DNA shuffling can be carried out between several related genes ("Family shuffling").

The term "in vivo mutagenesis" refers to a process of generating random mutations in any cloned DNA of interest which involves the propagation of the DNA in a strain of bacteria such as *E. coli* that carries mutations in one or more of the DNA repair pathways. These "mutator" strains have a higher random mutation rate than that of a wild-type parent. Propagating the DNA in a mutator strain will eventually generate random mutations within the DNA.

The term "cassette mutagenesis" refers to any process for replacing a small region of a double-stranded DNA molecule with a synthetic oligonucleotide "cassette" that differs from the native sequence. The oligonucleotide often contains completely and/or partially randomized native sequence.

The term "recursive ensemble mutagenesis" refers to an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. See, e.g., Arkin et al., *Proc. Natl. Acad. Sci. U.S.A.* 89: 7811-7815 (1992).

The term "exponential ensemble mutagenesis" refers to a process for generating combinatorial libraries with a high percentage of unique and functional mutants, wherein small groups of residues are randomized in parallel to identify, at each altered position, amino acids which lead to functional proteins. See, e.g., Delegrave et al., *Biotechnology Research* 11: 1548-1552 (1993); Arnold, *Current Opinion in Biotechnology* 4: 450-455 (1993).

"Operatively linked" expression control sequences refers to a linkage in which the expression control sequence is either contiguous with the gene of interest to control the gene of interest, or acts in trans or at a distance to control the gene of interest.

The term "expression control sequence" as used herein refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to include, at a minimum, all components whose presence is essential for expression, and can also include additional components whose presence is advantageous, for example, leader sequences and fusion partner sequences.

The term "vector," as used herein, is intended to refer to a nucleic acid molecule capable of transporting another nucleic acid to which it has been linked. One type of vector is a "plasmid", which refers to a circular double-stranded DNA loop into which additional DNA segments may be ligated. Other vectors include cosmids, bacterial artificial chromosomes (BAC) and yeast artificial chromosomes (YAC). Another type of vector is a viral vector, wherein additional DNA segments may be ligated into the viral genome. Viral vectors that infect bacterial cells are referred to as bacteriophages. Certain vectors are capable of autonomous replication in a host cell into which they are introduced (e.g., bacterial vectors having a bacterial origin of replication). Other vectors can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include other forms of expression vectors that serve equivalent functions.

The term "recombinant host cell" (or simply "host cell"), as used herein, is intended to refer to a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

As used herein, the phrase "open reading frame" and the equivalent acronym "ORF" refers to that portion of a transcript-derived nucleic acid that can be translated in its entirety into a sequence of contiguous amino acids. As so defined, an ORF has length, measured in nucleotides, exactly divisible by 3. As so defined, an ORF need not encode the entirety of a natural protein.

As used herein, the phrase "ORF-encoded peptide" refers to the predicted or actual translation of an ORF.

As used herein, the phrase "degenerate variant" of a reference nucleic acid sequence is meant to be inclusive of all nucleic acid sequences that can be directly translated, using the standard genetic code, to provide an amino acid sequence identical to that translated from the reference nucleic acid sequence.

The term "polypeptide" encompasses both naturally occurring and non-naturally occurring proteins and polypeptides, as well as polypeptide fragments and polypeptide mutants, derivatives and analogs thereof. A polypeptide may be monomeric or polymeric. Further, a polypeptide may comprise a number of different modules within a single polypeptide each of which has one or more distinct activities. A preferred polypeptide in accordance with the invention comprises an OSP encoded by a nucleic acid molecule of the instant invention, or a fragment, mutant, analog or derivative thereof.

The term "isolated protein" or "isolated polypeptide" is a protein or polypeptide that by virtue of its origin or source of derivation (1) is not associated with naturally associated components that accompany it in its native state, (2) is free of other proteins from the same species (3) is expressed by a cell from a different species, or (4) does not occur in nature. Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art.

A protein or polypeptide is "substantially pure," "substantially homogeneous" or "substantially purified" when at least about 60% to 75% of a sample exhibits a single species of polypeptide. The polypeptide or protein may be monomeric or multimeric. A substantially pure polypeptide or protein will typically comprise about 50%, 60%, 70%, 80% or 90% W/W of a protein sample, more usually about 95%, and preferably will be over 99% pure. Protein purity or homogeneity may be determined by a number of means well known in the art, such as polyacrylamide gel electrophoresis of a protein sample, followed by visualizing a single polypeptide band upon staining the gel with a stain well known in the art. For certain purposes, higher resolution may be provided by using HPLC or other means well known in the art for purification.

The term "fragment" when used herein with respect to polypeptides of the present invention refers to a polypeptide that has an amino-terminal and/or carboxy-terminal deletion compared to a full-length OSP. In a preferred embodiment, the fragment is a contiguous sequence in which the amino acid sequence of the fragment is identical to the corresponding positions in the naturally occurring polypeptide. Fragments typically are at least 5, 6, 7, 8, 9 or 10 amino acids long, preferably at least 12, 14, 16 or 18 amino acids long, more preferably at least 20 amino acids long, more preferably at least 25, 30, 35, 40 or 45, amino acids, even more preferably at least 50 or 60 amino acids long, and even more preferably at least 70 amino acids long.

A "derivative" when used herein with respect to polypeptides of the present invention refers to a polypeptide which is substantially similar in primary structural sequence to an OSP but which includes, e.g., in vivo or in vitro chemical and biochemical modifications that are not found in the OSP. Such modifications include, for example, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cystine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination. Other modifications include, e.g., labeling with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}I$, $^{32}P$, $^{35}S$, $^{14}C$ and $^{3}H$, ligands which bind to labeled antiligands (e.g., antibodies), fluorophores, chemiluminescent agents, enzymes, and antiligands which can serve as specific binding pair members for a labeled ligand. The choice of label depends on the sensitivity required, ease of conjugation with the primer, stability requirements, and available instrumentation. Methods for labeling polypeptides are well known in the art. See Ausubel (1992), supra; Ausubel (1999), supra.

The term "fusion protein" refers to polypeptides of the present invention coupled to a heterologous amino acid sequence. Fusion proteins are useful because they can be constructed to contain two or more desired functional elements from two or more different proteins. A fusion protein comprises at least 10 contiguous amino acids from a polypeptide of interest, more preferably at least 20 or 30 amino acids, even more preferably at least 40, 50 or 60 amino acids, yet more preferably at least 75, 100 or 125 amino acids. Fusion proteins can be produced recombinantly by constructing a nucleic acid sequence that encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

The term "analog" refers to both polypeptide analogs and non-peptide analogs. The term "polypeptide analog" as used herein refers to a polypeptide that is comprised of a segment of at least 25 amino acids that has substantial identity to a portion of an amino acid sequence but which contains non-natural amino acids or non-natural inter-residue bonds. In a preferred embodiment, the analog has the same or similar biological activity as the native polypeptide. Typically, polypeptide analogs comprise a conservative amino acid substitution (or insertion or deletion) with respect to the naturally occurring sequence. Analogs typically are at least 20 amino acids long, preferably at least 50 amino acids long or longer, and can often be as long as a full-length naturally occurring polypeptide.

The term "non-peptide analog" refers to a compound with properties that are analogous to those of a reference polypeptide. A non-peptide compound may also be termed a "peptide mimetic" or a "peptidomimetic." Such compounds are often developed with the aid of computerized molecular modeling. Peptide mimetics that are structurally similar to useful peptides may be used to produce an equivalent effect. Generally, peptidomimetics are structurally similar to a paradigm polypeptide (i.e., a polypeptide that has a desired biochemical property or pharmacological activity), but have one or more peptide linkages optionally replaced by a linkage selected from the group consisting of: —CH$_2$NH—, —CH$_2$S—, —CH$_2$—CH$_2$—, —CH═CH—(cis and trans), —COCH$_2$—, —CH(OH)CH$_2$—, and —CH$_2$SO—, by methods well known in the art. Systematic substitution of one or more amino acids of a consensus sequence with a D-amino acid of the same type (e.g., D-lysine in place of L-lysine) may also be used to generate more stable peptides. In addition, constrained peptides comprising a consensus sequence or a substantially identical consensus sequence variation may be generated by methods known in the art (Rizo et al., *Ann. Rev. Biochem.* 61:387-418 (1992)). For example, one may add internal cysteine residues capable of forming intramolecular disulfide bridges which cyclize the peptide.

The term "mutant" or "mutein" when referring to a polypeptide of the present invention relates to an amino acid sequence containing substitutions, insertions or deletions of one or more amino acids compared to the amino acid sequence of an OSP. A mutein may have one or more amino acid point substitutions, in which a single amino acid at a position has been changed to another amino acid, one or more insertions and/or deletions, in which one or more amino acids are inserted or deleted, respectively, in the sequence of the naturally occurring protein, and/or truncations of the amino acid sequence at either or both the amino or carboxy termini. Further, a mutein may have the same or different biological activity as the naturally occurring protein. For instance, a mutein may have an increased or decreased biological activity. A mutein has at least 50% sequence similarity to the wild type protein, preferred is 60% sequence similarity, more preferred is 70% sequence similarity. Even more preferred are muteins having 80%, 85% or 90% sequence similarity to an OSP. In an even more preferred embodiment, a mutein exhibits 95% sequence identity, even more preferably 97%, even more preferably 98% and even more preferably 99%. Sequence similarity may be measured by any common sequence analysis algorithm, such as GAP or BESTFIT or other variation Smith-Waterman alignment. See, T. F. Smith and M. S. Waterman, J. Mol. Biol. 147:195-197 (1981) and W. R. Pearson, Genomics 11:635-650 (1991).

Preferred amino acid substitutions are those which: (1) reduce susceptibility to proteolysis, (2) reduce susceptibility to oxidation, (3) alter binding affinity for forming protein complexes, (4) alter binding affinity or enzymatic activity, and (5) confer or modify other physicochemical or functional properties of such analogs. For example, single or multiple amino acid substitutions (preferably conservative amino acid substitutions) may be made in the naturally occurring sequence (preferably in the portion of the polypeptide outside the domain(s) forming intermolecular contacts. In a preferred embodiment, the amino acid substitutions are moderately conservative substitutions or conservative substitutions. In a more preferred embodiment, the amino acid substitutions are conservative substitutions. A conservative amino acid substitution should not substantially change the structural characteristics of the parent sequence (e.g., a replacement amino acid should not tend to disrupt a helix that occurs in the parent sequence, or disrupt other types of secondary structure that characterize the parent sequence). Examples of art-recognized polypeptide secondary and tertiary structures are described in Creighton (ed.), *Proteins, Structures and Molecular Principles*, W. H. Freeman and Company (1984); Branden et al. (ed.), *Introduction to Protein Structure*, Garland Publishing (1991); Thornton et al., *Nature* 354:105-106 (1991).

As used herein, the twenty conventional amino acids and their abbreviations follow conventional usage. See Golub et al. (eds.), *Immunology—A Synthesis* $2^{nd}$ Ed., Sinauer Associates (1991). Stereoisomers (e.g., D-amino acids) of the twenty conventional amino acids, unnatural amino acids such as α-, α-disubstituted amino acids, N-alkyl amino acids, and other unconventional amino acids may also be suitable components for polypeptides of the present invention. Examples of unconventional amino acids include: 4-hydroxyproline, γ-carboxyglutamate, εE-N,N,N-trimethyllysine, ε-N-acetyllysine, O-phosphoserine, N-acetylserine, N-formylmethionine, 3-methylhistidine, 5-hydroxylysine, s-N-methylarginine, and other similar amino acids and imino acids (e.g., 4-hydroxyproline). In the polypeptide notation used herein, the lefthand direction is the amino terminal direction and the right hand direction is the carboxy-terminal direction, in accordance with standard usage and convention.

By "homology" or "homologous" when referring to a polypeptide of the present invention it is meant polypeptides from different organisms with a similar sequence to the encoded amino acid sequence of an OSP and a similar biological activity or function. Although two polypeptides are said to be "homologous," this does not imply that there is necessarily an evolutionary relationship between the polypeptides. Instead, the term "homologous" is defined to mean that the two polypeptides have similar amino acid sequences and similar biological activities or functions. In a preferred embodiment, a homologous polypeptide is one that exhibits 50% sequence similarity to OSP, preferred is 60% sequence similarity, more preferred is 70% sequence similarity. Even more preferred are homologous polypeptides that exhibit 80%, 85% or 90% sequence similarity to an OSP. In yet a more preferred embodiment, a homologous polypeptide exhibits 95%, 97%, 98% or 99% sequence similarity.

When "sequence similarity" is used in reference to polypeptides, it is recognized that residue positions that are not identical often differ by conservative amino acid substitutions. In a preferred embodiment, a polypeptide that has "sequence similarity" comprises conservative or moderately conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well known to those of skill in the art. See, e.g., Pearson, *Methods Mol. Biol.* 24: 307-31 (1994).

For instance, the following six groups each contain amino acids that are conservative substitutions for one another:
1) Serine (S), Threonine (T);
2) Aspartic Acid (D), Glutamic Acid (E);
3) Asparagine (N), Glutamine (Q);
4) Arginine (R), Lysine (K);
5) Isoleucine (I), Leucine (L), Methionine (M), Alanine (A), Valine (V), and
6) Phenylalanine (F), Tyrosine (Y), Tryptophan (W).

Alternatively, a conservative replacement is any change having a positive value in the PAM250 log-likelihood matrix disclosed in Gonnet et al., *Science* 256: 1443-45 (1992). A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild type protein and a mutein thereof. See, e.g., GCG Version 6.1. Other programs include FASTA, discussed supra.

A preferred algorithm when comparing a sequence of the invention to a database containing a large number of sequences from different organisms is the computer program BLAST, especially blastp or tblastn. See, e.g., Altschul et al., *J. Mol. Biol.* 215: 403-410 (1990); Altschul et al., *Nucleic Acids Res.* 25:3389-402 (1997). Preferred parameters for blastp are:

| | |
|---|---|
| Expectation value: | 10 (default) |
| Filter: | seg (default) |
| Cost to open a gap: | 11 (default) |
| Cost to extend a gap: | 1 (default) |
| Max. alignments: | 100 (default) |
| Word size: | 11 (default) |
| No. of descriptions: | 100 (default) |
| Penalty Matrix: | BLOSUM62 |

The length of polypeptide sequences compared for homology will generally be at least about 16 amino acid residues, usually at least about 20 residues, more usually at least about 24 residues, typically at least about 28 residues, and preferably more than about 35 residues. When searching a database containing sequences from a large number of different organisms, it is preferable to compare amino acid sequences.

Algorithms other than blastp for database searching using amino acid sequences are known in the art. For instance, polypeptide sequences can be compared using FASTA, a program in GCG Version 6.1. FASTA (e.g., FASTA2 and FASTA3) provides alignments and percent sequence identity of the regions of the best overlap between the query and search sequences (Pearson (1990), supra; Pearson (2000), supra. For example, percent sequence identity between amino acid sequences can be determined using FASTA with its default or recommended parameters (a word size of 2 and the PAM250 scoring matrix), as provided in GCG Version 6.1.

An "antibody" refers to an intact immunoglobulin, or to an antigen-binding portion thereof that competes with the intact antibody for specific binding to a molecular species, e.g., a polypeptide of the instant invention. Antigen-binding portions may be produced by recombinant DNA techniques or by enzymatic or chemical cleavage of intact antibodies. Antigen-binding portions include, inter alia, Fab, Fab', F(ab')$_2$, Fv, dAb, and complementarity determining region (CDR) fragments, single-chain antibodies (scFv), chimeric antibodies, diabodies and polypeptides that contain at least a portion of an immunoglobulin that is sufficient to confer specific antigen binding to the polypeptide. A Fab fragment is a monovalent fragment consisting of the VL, VH, CL and CH1 domains; a F(ab')$_2$ fragment is a bivalent fragment comprising two Fab fragments linked by a disulfide bridge at the hinge region; a Fd fragment consists of the VH and CH1 domains; a Fv fragment consists of the VL and VH domains of a single arm of an antibody; and a dAb fragment consists of a VH domain. See, e.g., Ward et al., *Nature* 341: 544-546 (1989).

By "bind specifically" and "specific binding" as used herein it is meant the ability of the antibody to bind to a first molecular species in preference to binding to other molecular species with which the antibody and first molecular species are admixed. An antibody is said to "recognize" a first molecular species when it can bind specifically to that first molecular species.

A single-chain antibody (scFv) is an antibody in which VL and VH regions are paired to form a monovalent molecule via a synthetic linker that enables them to be made as a single protein chain. See, e.g., Bird et al., *Science* 242: 423-426 (1988); Huston et al., *Proc. Natl. Acad. Sci. USA* 85: 5879-5883 (1988). Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites. See e.g., Holliger et al., *Proc. Natl. Acad. Sci. USA* 90: 6444-6448 (1993); Poljak et al., *Structure* 2: 1121-1123 (1994). One or more CDRs may be incorporated into a molecule either covalently or noncovalently to make it an immunoadhesin. An immunoadhesin may incorporate the CDR(s) as part of a larger polypeptide chain, may covalently link the CDR(s) to another polypeptide chain, or may incorporate the CDR(s) noncovalently. The CDRs permit the immunoadhesin to specifically bind to a particular antigen of interest. A chimeric antibody is an antibody that contains one or more regions from one antibody and one or more regions from one or more other antibodies.

An antibody may have one or more binding sites. If there is more than one binding site, the binding sites may be identical to one another or may be different. For instance, a naturally occurring immunoglobulin has two identical binding sites, a single-chain antibody or Fab fragment has one binding site, while a "bispecific" or "bifunctional" antibody has two different binding sites.

An "isolated antibody" is an antibody that (1) is not associated with naturally-associated components, including other naturally-associated antibodies, that accompany it in its native state, (2) is free of other proteins from the same species, (3) is expressed by a cell from a different species, or (4) does not occur in nature. It is known that purified proteins, including purified antibodies, may be stabilized with non-naturally-associated components. The non-naturally-associated component may be a protein, such as albumin (e.g., BSA) or a chemical such as polyethylene glycol (PEG).

A "neutralizing antibody" or "an inhibitory antibody" is an antibody that inhibits the activity of a polypeptide or blocks the binding of a polypeptide to a ligand that normally binds to it. An "activating antibody" is an antibody that increases the activity of a polypeptide.

The term "epitope" includes any protein determinant capable of specific binding to an immunoglobulin or T-cell receptor. Epitopic determinants usually consist of chemically active surface groupings of molecules such as amino acids or sugar side chains and usually have specific three-dimensional structural characteristics, as well as specific charge characteristics. An antibody is said to specifically bind an antigen when the dissociation constant is less than 1 µM, preferably less than 100 nM and most preferably less than 10 nM.

The term "patient" includes human and veterinary subjects.

Throughout this specification and claims, the word "comprise," or variations such as "comprises" or "comprising," will be understood to imply the inclusion of a stated integer or group of integers but not the exclusion of any other integer or group of integers.

The term "ovarian specific" refers to a nucleic acid molecule or polypeptide that is expressed predominantly in the ovarian as compared to other tissues in the body. In a preferred embodiment, a "ovarian specific" nucleic acid molecule or polypeptide is detected at a level that is 1.5-fold higher than any other tissue in the body. In a more preferred embodiment, the "ovarian specific" nucleic acid molecule or polypeptide is detected at a level that is 2-fold higher than any other tissue in the body, more preferably 5-fold higher, still more preferably at least 10-fold, 15-fold, 20-fold, 25-fold, 50-fold or 100-fold higher than any other tissue in the body. Nucleic acid molecule levels may be measured by nucleic acid hybridization, such as Northern blot hybridization, or quantitative PCR. Polypeptide levels may be measured by any method known to accurately quantitate protein levels, such as Western blot analysis.

Nucleic Acid Molecules, Regulatory Sequences, Vectors, Host Cells and Recombinant Methods of Making Polypeptides Nucleic Acid Molecules One aspect of the invention provides isolated nucleic acid molecules that are specific to the ovarian or to ovarian cells or tissue or that are derived from such nucleic acid molecules. These isolated ovarian specific nucleic acids (OSNAs) may comprise cDNA genomic DNA, RNA, or a combination thereof, a fragment of one of these nucleic acids, or may be a non-naturally occurring nucleic acid molecule. An OSNA may be derived from an animal. In a preferred embodiment, the OSNA is derived from a human or other mammal. In a more preferred embodiment, the OSNA is derived from a human or other primate. In an even more preferred embodiment, the OSNA is derived from a human.

In a preferred embodiment, the nucleic acid molecule encodes a polypeptide that is specific to ovarian, an ovarian-specific polypeptide (OSP). In a more preferred embodiment, the nucleic acid molecule encodes a polypeptide that comprises an amino acid sequence of SEQ ID NO: 129-295. In another highly preferred embodiment, the nucleic acid molecule comprises a nucleic acid sequence of SEQ ID NO: 1-128. Nucleotide sequences of the instantly-described nucleic acid molecules were determined by assembling several DNA molecules from either public or proprietary databases. Some of the underlying DNA sequences are the result, directly or indirectly, of at least one enzymatic polymerization reaction (e.g., reverse transcription and/or polymerase chain reaction) using an automated sequencer (such as the MegaBACE™ 1000, Amersham Biosciences, Sunnyvale, Calif., USA).

Nucleic acid molecules of the present invention may also comprise sequences that selectively hybridize to a nucleic acid molecule encoding an OSNA or a complement or antisense thereof. The hybridizing nucleic acid molecule may or may not encode a polypeptide or may or may not encode an OSP. However, in a preferred embodiment, the hybridizing nucleic acid molecule encodes an OSP. In a more preferred embodiment, the invention provides a nucleic acid molecule that selectively hybridizes to a nucleic acid molecule or the antisense sequence of a nucleic acid molecule that encodes a polypeptide comprising an amino acid sequence of SEQ ID NO: 129-295. In an even more preferred embodiment, the invention provides a nucleic acid molecule that selectively hybridizes to a nucleic acid molecule comprising the nucleic acid sequence of SEQ ID NO: 1-128 or the antisense sequence thereof. Preferably, the nucleic acid molecule selectively hybridizes to a nucleic acid molecule or the antisense sequence of a nucleic acid molecule encoding an OSP under low stringency conditions. More preferably, the nucleic acid molecule selectively hybridizes to a nucleic acid molecule or the antisense sequence of a nucleic acid molecule encoding an OSP under moderate stringency conditions. Most preferably, the nucleic acid molecule selectively hybridizes to a nucleic acid molecule or the antisense sequence of a nucleic acid molecule encoding an OSP under high stringency conditions. In a preferred embodiment, the nucleic acid molecule hybridizes under low, moderate or high stringency conditions to a nucleic acid molecule or the antisense sequence of a nucleic acid molecule encoding a polypeptide comprising an amino acid sequence of SEQ ID NO: 129-295. In a more preferred embodiment, the nucleic acid molecule hybridizes under low, moderate or high stringency conditions to a nucleic acid molecule or the antisense sequence of a nucleic acid molecule comprising a nucleic acid sequence selected from SEQ ID NO: 1-128.

Nucleic acid molecules of the present invention may also comprise nucleic acid sequences that exhibit substantial sequence similarity to a nucleic acid encoding an OSP or a complement of the encoding nucleic acid molecule. In this embodiment, it is preferred that the nucleic acid molecule exhibit substantial sequence similarity to a nucleic acid molecule encoding human OSP. More preferred is a nucleic acid molecule exhibiting substantial sequence similarity to a nucleic acid molecule encoding a polypeptide having an amino acid sequence of SEQ ID NO: 129-295. By substantial sequence similarity it is meant a nucleic acid molecule having at least 60%, more preferably at least 70%, even more preferably at least 80% and even more preferably at least 85% sequence identity with a nucleic acid molecule encoding an OSP, such as a polypeptide having an amino acid sequence of SEQ ID NO: 129-295. In a more preferred embodiment, the similar nucleic acid molecule is one that has at least 90%, more preferably at least 95%, more preferably at least 97%, even more preferably at least 98%, and still more preferably at least 99% sequence identity with a nucleic acid molecule encoding an OSP. Most preferred in this embodiment is a nucleic acid molecule that has at least 99.5%, 99.6%, 99.7%, 99.8% or 99.9% sequence identity with a nucleic acid molecule encoding an OSP.

The nucleic acid molecules of the present invention are also inclusive of those exhibiting substantial sequence similarity to an OSNA or its complement. In this embodiment, it is preferred that the nucleic acid molecule exhibit substantial sequence similarity to a nucleic acid molecule having a nucleic acid sequence of SEQ ID NO: 1-128. By substantial sequence similarity it is meant a nucleic acid molecule that has at least 60%, more preferably at least 70%, even more preferably at least 80% and even more preferably at least 85% sequence identity with an OSNA, such as one having a nucleic acid sequence of SEQ ID NO: 1-128. More preferred is a nucleic acid molecule that has at least 90%, more preferably at least 95%, more preferably at least 97%, even more preferably at least 98%, and still more preferably at least 99% sequence identity with an OSNA. Most preferred is a nucleic acid molecule that has at least 99.5%, 99.6%, 99.7%, 99.8% or 99.9% sequence identity with an OSNA.

Nucleic acid molecules that exhibit substantial sequence similarity are inclusive of sequences that exhibit sequence identity over their entire length to an OSNA or to a nucleic acid molecule encoding an OSP, as well as sequences that are similar over only a part of its length. In this case, the part is at least 50 nucleotides of the OSNA or the nucleic acid molecule encoding an OSP, preferably at least 100 nucleotides, more preferably at least 150 or 200 nucleotides, even more preferably at least 250 or 300 nucleotides, still more preferably at least 400 or 500 nucleotides.

The substantially similar nucleic acid molecule may be a naturally occurring one that is derived from another species, especially one derived from another primate, wherein the similar nucleic acid molecule encodes an amino acid sequence that exhibits significant sequence identity to that of SEQ ID NO: 129-295 or demonstrates significant sequence identity to the nucleotide sequence of SEQ ID NO: 1-128. The similar nucleic acid molecule may also be a naturally occurring nucleic acid molecule from a human, when the OSNA is a member of a gene family. The similar nucleic acid molecule may also be a naturally occurring nucleic acid molecule derived from a non-primate, mammalian species, including without limitation, domesticated species, e.g., dog, cat, mouse, rat, rabbit, hamster, cow, horse and pig; and wild animals, e.g., monkey, fox, lions, tigers, bears, giraffes, zebras, etc. The substantially similar nucleic acid molecule may also be a naturally occurring nucleic acid molecule derived from a non-mammalian species, such as birds or reptiles. The naturally occurring substantially similar nucleic acid molecule may be isolated directly from humans or other species. In another embodiment, the substantially similar nucleic acid molecule may be one that is experimentally produced by random mutation of a nucleic acid molecule. In another embodiment, the substantially similar nucleic acid molecule may be one that is experimentally produced by directed mutation of an OSNA. In a preferred embodiment, the substantially similar nucleic acid molecule is an OSNA.

The nucleic acid molecules of the present invention are also inclusive of allelic variants of an OSNA or a nucleic acid encoding an OSP. For example, single nucleotide polymorphisms (SNPs) occur frequently in eukaryotic genomes and the sequence determined from one individual of a species may differ from other allelic forms present within the population. More than 1.4 million SNPs have already been identified in the human genome, International Human Genome Sequencing Consortium, *Nature* 409: 860-921 (2001)—Variants with small deletions and insertions of more than a single nucleotide are also found in the general population, and often do not alter the function of the protein. In addition, amino acid substitutions occur frequently among natural allelic variants, and often do not substantially change protein function.

In a preferred embodiment, the allelic variant is a variant of a gene, wherein the gene is transcribed into a mRNA that encodes an OSP. In a more preferred embodiment, the gene is transcribed into a mRNA that encodes an OSP comprising an amino acid sequence of SEQ ID NO: 129-295. In another preferred embodiment, the allelic variant is a variant of a gene, wherein the gene is transcribed into a mRNA that is an OSNA. In a more preferred embodiment, the gene is transcribed into a mRNA that comprises the nucleic acid sequence of SEQ ID NO: 1-128. Also preferred is that the allelic variant be a naturally occurring allelic variant in the species of interest, particularly human.

Nucleic acid molecules of the present invention are also inclusive of nucleic acid sequences comprising a part of a nucleic acid sequence of the instant invention. The part may or may not encode a polypeptide, and may or may not encode a polypeptide that is an OSP. In a preferred embodiment, the part encodes an OSP. In one embodiment, the nucleic acid molecule comprises a part of an OSNA. In another embodiment, the nucleic acid molecule comprises a part of a nucleic acid molecule that hybridizes or exhibits substantial sequence similarity to an OSNA. In another embodiment, the nucleic acid molecule comprises a part of a nucleic acid molecule that is an allelic variant of an OSNA. In yet another embodiment, the nucleic acid molecule comprises a part of a nucleic acid molecule that encodes an OSP. A part comprises at least 10 nucleotides, more preferably at least 15, 17, 18, 20, 25, 30, 35, 40, 50, 60, 70, 80, 90, 100, 150, 200, 250, 300, 350, 400 or 500 nucleotides. The maximum size of a nucleic acid part is one nucleotide shorter than the sequence of the nucleic acid molecule encoding the full-length protein.

Nucleic acid molecules of the present invention are also inclusive of nucleic acid sequences that encode fusion proteins, homologous proteins, polypeptide fragments, muteins and polypeptide analogs, as described infra.

Nucleic acid molecules of the present invention are also inclusive of nucleic acid sequences containing modifications of the native nucleic acid molecule. Examples of such modifications include, but are not limited to, normative internucleoside bonds, post-synthetic modifications or altered nucleotide analogues. One having ordinary skill in the art would recognize that the type of modification that may be made will depend upon the intended use of the nucleic acid molecule. For instance, when the nucleic acid molecule is used as a hybridization probe, the range of such modifications will be limited to those that permit sequence-discriminating base pairing of the resulting nucleic acid. When used to direct expression of RNA or protein in vitro or in vivo, the range of such modifications will be limited to those that permit the nucleic acid to function properly as a polymerization substrate. When the isolated nucleic acid is used as a therapeutic agent, the modifications will be limited to those that do not confer toxicity upon the isolated nucleic acid.

Accordingly, in one embodiment, a nucleic acid molecule may include nucleotide analogues that incorporate labels that are directly detectable, such as radiolabels or fluorophores, or nucleotide analogues that incorporate labels that can be visualized in a subsequent reaction, such as biotin or various haptens. The labeled nucleic acid molecules are particularly useful as hybridization probes.

Common radiolabeled analogues include those labeled with $^{33}$P, $^{32}$P, and $^{35}$S, such as $\alpha$-$^{32}$P-dATP, $\alpha$-$^{32}$P-dCTP, $\alpha$-$^{32}$P-dGTP, $\alpha$-$^{32}$P-dTTP, $\alpha$-$^{32}$P-3'dATP, $\alpha$-$^{32}$P-ATP, $\alpha$-$^{32}$P-CTP, $\alpha$-$^{32}$P-GTP, $\alpha$-$^{32}$P-UTP, $\alpha$-$^{35}$S-dATP, $\gamma$-$^{35}$S-GTP, $\gamma$-$^{33}$P-dATP, and the like.

Commercially available fluorescent nucleotide analogues readily incorporated into the nucleic acids of the present invention include Cy3-dCTP, Cy3-dUTP, Cy5-dCTP, Cy3-dUTP (Amersham Biosciences, Piscataway, N.J., USA), fluorescein-12-dUTP, tetramethylrhodamine-6-dUTP, Texas Red®-5-dUTP, Cascade Blue®-7-dUTP, BODIPY® FL-14-dUTP, BODIPY® TMR-14-dUTP, BODIPY® TR-14-dUTP, Rhodamine Green™-5-dUTP, Oregon Green® 488-5-dUTP, Texas Red®-12-dUTP, BODIPY® 630/650-14-dUTP, BODIPY® 650/665-14-dUTP, Alexa Fluor® 488-5-dUTP, Alexa Fluor® 532-5-dUTP, Alexa Fluor® 568-5-dUTP, Alexa Fluor® 594-5-dUTP, Alexa Fluor® 546-14-dUTP, fluorescein-12-UTP, tetramethylrhodamine-6-UTP, Texas Red®-5-UTP, Cascade Blue®-7-UTP, BODIPY® FL-14-UTP, BODIPY® TMR-14-UTP, BODIPY® TR-14-UTP, Rhodamine Green™-5-UTP, Alexa Fluor® 488-5-UTP, Alexa Fluor® 546-14-UTP (Molecular Probes, Inc. Eugene, Oreg., USA). One may also custom synthesize nucleotides having other fluorophores. See Henegariu et al., *Nature Biotechnol.* 18: 345-348 (2000).

Haptens that are commonly conjugated to nucleotides for subsequent labeling include biotin (biotin-11-dUTP, Molecular Probes, Inc., Eugene, Oreg., USA; biotin-21-UTP, biotin-21-dUTP, Clontech Laboratories, Inc., Palo Alto, Calif., USA), digoxigenin (DIG-11-dUTP, alkali labile, DIG-11-UTP, Roche Diagnostics Corp., Indianapolis, Ind., USA), and dinitrophenyl (dinitrophenyl-11-dUTP, Molecular Probes, Inc., Eugene, Oreg., USA).

Nucleic acid molecules of the present invention can be labeled by incorporation of labeled nucleotide analogues into the nucleic acid. Such analogues can be incorporated by enzymatic polymerization, such as by nick translation, random priming, polymerase chain reaction (PCR), terminal transferase tailing, and end-filling of overhangs, for DNA molecules, and in vitro transcription driven, e.g., from phage promoters, such as T7, T3, and SP6, for RNA molecules. Commercial kits are readily available for each such labeling approach. Analogues can also be incorporated during automated solid phase chemical synthesis. Labels can also be incorporated after nucleic acid synthesis, with the 5' phosphate and 3' hydroxyl providing convenient sites for post-synthetic covalent attachment of detectable labels.

Other post-synthetic approaches also permit internal labeling of nucleic acids. For example, fluorophores can be attached using a cisplatin reagent that reacts with the N7 of guanine residues (and, to a lesser extent, adenine bases) in DNA, RNA, and Peptide Nucleic Acids (PNA) to provide a stable coordination complex between the nucleic acid and fluorophore label (Universal Linkage System) (available from Molecular Probes, Inc., Eugene, Oreg., USA and Amersham Pharmacia Biotech, Piscataway, N.J., USA); see Alers et al., *Genes, Chromosomes & Cancer* 25: 301-305 (1999); Jelsma et al., *J. NIH Res.* 5: 82 (1994); Van Belkum et al., *BioTechniques* 16: 148-153 (1994). Alternatively, nucleic acids can be labeled using a disulfide-containing linker (Fast-Tag™ Reagent, Vector Laboratories, Inc., Burlingame, Calif., USA) that is photo- or thermally coupled to the target nucleic acid using aryl azide chemistry; after reduction, a free thiol is available for coupling to a hapten, fluorophore, sugar, affinity ligand, or other marker.

One or more independent or interacting labels can be incorporated into the nucleic acid molecules of the present invention. For example, both a fluorophore and a moiety that in proximity thereto acts to quench fluorescence can be included to report specific hybridization through release of fluorescence quenching or to report exonucleotidic excision. See, e.g., Tyagi et al., *Nature Biotechnol.* 14: 303-308 (1996); Tyagi et al., *Nature Biotechnol.* 16: 49-53 (1998); Sokol et al., *Proc. Natl. Acad. Sci. USA* 95: 11538-11543 (1998); Kostrikis et al., *Science* 279: 1228-1229 (1998); Marras et al., *Genet. Anal.* 14: 151-156 (1999); Holland et al., *Proc. Natl. Acad. Sci. USA* 88: 7276-7280 (1991); Heid et al., *Genome Res.* 6(10): 986-94 (1996); Kuimelis et al., *Nucleic Acids Symp. Ser.* (37): 255-6 (1997); and U.S. Pat. Nos. 5,846,726, 5,925,517, 5,925,517, 5,723,591 and 5,538,848, the disclosures of which are incorporated herein by reference in their entireties.

Nucleic acid molecules of the present invention may also be modified by altering one or more native phosphodiester internucleoside bonds to more nuclease-resistant, internucleoside bonds. See Hartmann et al. (eds.), *Manual of Antisense Methodology: Perspectives in Antisense Science*, Kluwer Law International (1999); Stein et al. (eds.), *Applied Antisense Oligonucleotide Technology*, Wiley-Liss (1998); Chadwick et al. (eds.), *Oligonucleotides as Therapeutic Agents—Symposium No. 209*, John Wiley & Son Ltd (1997). Such altered internucleoside bonds are often desired for techniques or for targeted gene correction, Gamper et al., *Nucl. Acids Res.* 28(21): 4332-4339 (2000). For double-stranded RNA inhibition which may utilize either natural ds RNA or ds RNA modified in its, sugar, phosphate or base, see Hannon, *Nature* 418(11): 244-251 (2002); Fire et al. in WO 99/32619; Tuschl et al. in US2002/0086356; Kruetzer et al. in WO 00/44895, the disclosures of which are incorporated herein by reference in their entirety. For circular antisense, see Kool in U.S. Pat. No. 5,426,180, the disclosure of which is incorporated herein by reference in its entirety.

Modified oligonucleotide backbones include, without limitation, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Representative U.S. patents that teach the preparation of the above phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, the disclosures of which are incorporated herein by reference in their entireties. In a preferred embodiment, the modified internucleoside linkages may be used for antisense techniques.

Other modified oligonucleotide backbones do not include a phosphorus atom, but have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Representative U.S. patents that teach the preparation of the above backbones include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437 and 5,677,439; the disclosures of which are incorporated herein by reference in their entireties.

In other preferred nucleic acid molecules, both the sugar and the internucleoside linkage are replaced with novel groups, such as peptide nucleic acids (PNA). In PNA compounds, the phosphodiester backbone of the nucleic acid is replaced with an amide-containing backbone, in particular by repeating N-(2-aminoethyl) glycine units linked by amide bonds. Nucleobases are bound directly or indirectly to aza nitrogen atoms of the amide portion of the backbone, typically by methylene carbonyl linkages. PNA can be synthesized using a modified peptide synthesis protocol. PNA oligomers can be synthesized by both Fmoc and tBoc methods. Representative U.S. patents that teach the preparation of PNA compounds include, but are not limited to, U.S. Pat. Nos. 5,539,082; 5,714,331; and 5,719,262, each of which is herein incorporated by reference in its entirety. Automated PNA synthesis is readily achievable on commercial synthesizers (see, e.g., "PNA User's Guide," Rev. 2, February 1998, Perseptive Biosystems Part No. 60138, Applied Biosystems, Inc., Foster City, Calif.). PNA molecules are advantageous for a number of reasons. First, because the PNA backbone is uncharged, PNA/DNA and PNA/RNA duplexes have a higher thermal stability than is found in DNA/DNA and DNA/RNA duplexes. The Tm of a PNA/DNA or PNA/RNA duplex is generally 1° C. higher per base pair than the Tm of the corresponding DNA/DNA or DNA/RNA duplex (in 100 mM NaCl). Second, PNA molecules can also form stable PNA/DNA complexes at low ionic strength, under conditions in which DNA/DNA duplex formation does not occur. Third, PNA also demonstrates greater specificity in binding to complementary DNA because a PNA/DNA mismatch is more destabilizing than DNA/DNA mismatch. A single mismatch in mixed a PNA/DNA 15-mer lowers the Tm by 8-20° C. (15° C. on average). In the corresponding DNA/DNA duplexes, a single mismatch lowers the Tm by 4-16° C. (11° C. on average). Because PNA probes can be significantly shorter than DNA probes, their specificity is greater. Fourth, PNA oligomers are resistant to degradation by enzymes, and the lifetime of these compounds is extended both in vivo and in vitro because nucleases and proteases do not recognize the PNA polyamide backbone with nucleobase sidechains. See, e.g., Ray et al., *FASEB J.* 14(9): 1041-60 (2000); Nielsen et al., *Pharmacol Toxicol.* 86(1): 3-7 (2000); Larsen et al., *Biochim Biophys Acta.* 1489(1): 159-66 (1999); Nielsen, *Curr. Opin. Struct. Biol.* 9(3): 353-7 (1999), and Nielsen, *Curr. Opin. Biotechnol.* 10(1): 71-5 (1999).

Nucleic acid molecules may be modified compared to their native structure throughout the length of the nucleic acid molecule or can be localized to discrete portions thereof. As an example of the latter, chimeric nucleic acids can be synthesized that have discrete DNA and RNA domains and that can be used for targeted gene repair and modified PCR reactions, as further described in, Misra et al., *Biochem.* 37: 1917-1925 (1998); and Finn et al., *Nucl. Acids Res.* 24: 3357-3363 (1996), and U.S. Pat. Nos. 5,760,012 and 5,731,181, the disclosures of which are incorporated herein by reference in their entireties.

Unless otherwise specified, nucleic acid molecules of the present invention can include any topological conformation appropriate to the desired use; the term thus explicitly comprehends, among others, single-stranded, double-stranded, triplexed, quadruplexed, partially double-stranded, partially-triplexed, partially-quadruplexed, branched, hairpinned, circular, and padlocked conformations. Padlocked conformations and their utilities are further described in Banér et al., *Curr. Opin. Biotechnol.* 12: 11-15 (2001); Escude et al., *Proc. Natl. Acad. Sci. USA* 14: 96(19):10603-7 (1999); and Nilsson et al., *Science* 265(5181): 2085-8 (1994). Triplexed and quadruplexed conformations, and their utilities, are reviewed in Praseuth et al., *Biochim. Biophys. Acta.* 1489(1): 181-206 (1999); Fox, *Curr. Med. Chem.* 7(1): 17-37 (2000); Kochetkova et al., *Methods Mol. Biol.* 130: 189-201 (2000); Chan et al., *J. Mol. Med.* 75(4): 267-82 (1997); Rowley et al., *Mol Med* 5(10): 693-700 (1999); Kool, *Annu Rev Biophys Biomol Struct.* 25: 1-28 (1996).

SNP Polymorphisms

Commonly, sequence differences between individuals involve differences in single nucleotide positions. SNPs may account for 90% of human DNA polymorphism. Collins et al., 8 *Genome Res.* 1229-31 (1998). SNPs include single base pair positions in genomic DNA at which different sequence alternatives (alleles) exist in a population. In addition, the least frequent allele generally must occur at a frequency of 1% or greater. DNA sequence variants with a reasonably high population frequency are observed approximately every 1,000 nucleotide across the genome, with estimates as high as 1 SNP per 350 base pairs. Wang et al., 280 *Science* 1077-82 (1998); Harding et al., 60 Am. J. Human Genet. 772-89 (1997); Taillon-Miller et al., 8 *Genome Res.* 748-54 (1998); Cargill et al., 22 *Nat. Genet.* 231-38 (1999); and Semple et al., 16 *Bioinform. Disc. Note* 735-38 (2000). The frequency of SNPs varies with the type and location of the change. In base substitutions, two-thirds of the substitutions involve the C-T and G-A type. This variation in frequency can be related to 5-methylcytosine deamination reactions that occur frequently, particularly at CpG dinucleotides. Regarding location, SNPs occur at a much higher frequency in non-coding regions than in coding regions. Information on over one million variable sequences is already publicly available via the Internet and more such markers are available from commercial providers of genetic information. Kwok and Gu, 5 *Med. Today* 538-53 (1999).

Several definitions of SNPs exist. See, e.g., Brooks, 235 *Gene* 177-86 (1999). As used herein, the term "single nucleotide polymorphism" or "SNP" includes all single base variants, thus including nucleotide insertions and deletions in addition to single nucleotide substitutions. There are two types of nucleotide substitutions. A transition is the replacement of one purine by another purine or one pyrimidine by another pyrimidine. A transversion is the replacement of a purine for a pyrimidine, or vice versa.

Numerous methods exist for detecting SNPs within a nucleotide sequence. A review of many of these methods can be found in Landegren et al., 8 *Genome Res.* 769-76 (1998). For example, a SNP in a genomic sample can be detected by preparing a Reduced Complexity Genome (RCG) from the genomic sample, then analyzing the RCG for the presence or absence of a SNP. See, e.g., WO 00/18960 which is herein incorporated by reference in its entirety. Multiple SNPs in a population of target polynucleotides in parallel can be detected using, for example, the methods of WO 00/50869 which is herein incorporated by reference in its entirety. Other SNP detection methods include the methods of U.S. Pat. Nos. 6,297,018 and 6,322,980 which are herein incorporated by reference in their entirety. Furthermore, SNPs can be detected by restriction fragment length polymorphism (RFLP) analysis. See, e.g., U.S. Pat. Nos. 5,324,631; 5,645,995 which are herein incorporated by reference in their entirety. RFLP analysis of SNPs, however, is limited to cases where the SNP either creates or destroys a restriction enzyme cleavage site. SNPs can also be detected by direct sequencing of the nucleotide sequence of interest. In addition, numerous assays based on hybridization have also been developed to detect SNPs and mismatch distinction by polymerases and ligases. Several web sites provide information about SNPs including Ensembl on the World Wide Web at ensemble.org, Sanger Institute on the World Wide Web at sanger.ac.uk/genetics/exon/, National Center for Biotechnology Information (NCBI) on the World Wide Web at ncbi.nlm.nih.gov/SNP/, The SNP Consortium Ltd. on the World Wide Web at snp.c-shl.org. The chromosomal locations for the compositions disclosed herein are provided below. In addition, one of ordinary skill in the art could use a BLAST against the genome or any of the databases cited above to find the chromosomal location. Another a preferred method to find the genomic coordinates and associated SNPs would be to use the BLAT tool (genome.ucsc.edu, Kent et al. 2001, The Human Genome Browser at UCSC, Genome Research 996-1006 or Kent 2002 BLAT—The BLAST-Like Alignment Tool Genome Reseach, 1-9). All web sites above were accessed Dec. 3, 2003.

RNA Interference

RNA interference refers to the process of sequence-specific post transcriptional gene silencing in animals mediated by short interfering RNAs (siRNA). Fire et al., 1998, *Nature,* 391, 806. The corresponding process in plants is commonly referred to as post transcriptional gene silencing or RNA silencing and is also referred to as quelling in fungi. The process of post transcriptional gene silencing is thought to be an evolutionarily conserved cellular defense mechanism used to prevent the expression of foreign genes which is commonly shared by diverse flora and phyla. Fire et al., 1999, *Trends Genet.,* 15, 358. Such protection from foreign gene expression may have evolved in response to the production of double-stranded RNAs (dsRNA) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as dicer. Dicer is involved in the processing of the dsRNA into short pieces of dsRNA known as short interfering RNAs (siRNA). Berstein et al., 2001, *Nature*, 409, 363. Short interfering RNAs derived from dicer activity are typically about 21-23 nucleotides in length and comprise about 19 base pair duplexes. Dicer has also been implicated in the excision of 21 and 22 nucleotide small temporal RNAs (stRNA) from precursor RNA of conserved structure that are implicated in translational control. Hutvagner et al., 2001, *Science*, 293, 834. The RNAi response also features an endonuclease complex containing a siRNA, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex. Elbashir et al., 2001, *Genes Dev.*, 15, 188.

Short interfering RNA mediated RNAi has been studied in a variety of systems. Fire et al., 1998, *Nature*, 391, 806, were the first to observe RNAi in *C. Elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, *EMBO J.*, 20, 6877) has revealed certain requirements for siRNA length, structure, chemical composition, and sequence that are essential to mediate efficient RNAi activity. These studies have shown that 21 nucleotide siRNA duplexes are most active when containing two nucleotide 3'-overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end. Elbashir et al., 2001, *EMBO J.*, 20, 6877. Other studies have indicated that a 5'-phosphate on the target-complementary strand of a siRNA duplex is required for siRNA activity and that ATP is utilized to maintain the 5'-phosphate moiety on the siRNA. Nykanen et al., 2001, *Cell*, 107, 309.

Studies have shown that replacing the 3'-overhanging segments of a 21-mer siRNA duplex having 2 nucleotide 3' overhangs with deoxyribonucleotides does not have an adverse effect on RNAi activity. Replacing up to 4 nucleotides on each end of the siRNA with deoxyribonucleotides has been reported to be well tolerated whereas complete substitution with deoxyribonucleotides results in no RNAi activity. Elbashir et al., 2001, *EMBO J.*, 20, 6877. In addition, Elbashir et al., supra, also report that substitution of siRNA with 2'-O-methyl nucleotides completely abolishes RNAi activity. Li et al., WO 00/44914, and Beach et al., WO 01/68836 both suggest that siRNA "may include modifications to either the phosphate-sugar back bone or the nucleoside to include at least one of a nitrogen or sulfur heteroatom", however neither application teaches to what extent these modifications are tolerated in siRNA molecules nor provides any examples of such modified siRNA. Kreutzer and Limmer, Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. However, Kreutzer and Limmer similarly fail to show to what extent these modifications are tolerated in siRNA molecules nor do they provide any examples of such modified siRNA.

Parrish et al., 2000, *Molecular Cell*, 6, 1977-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that "RNAs with two [phosphorothioate] modified bases also had substantial decreases in effectiveness as RNAi triggers; [phosphorothioate] modification of more than two residues greatly destabilized the RNAs in vitro and we were not able to assay interference activities." Parrish et al. at 1081. The authors also tested certain modifications at the 2'-position of the nucleotide sugar in the long siRNA transcripts and observed that substituting deoxynucleotides for ribonucleotides "produced a substantial decrease in interference activity", especially in the case of Uridine to Thymidine and/or Cytidine to deoxy-Cytidine substitutions. Parrish et al. In addition, the authors tested certain base modifications, including substituting 4-thiouracil, 5-bromouracil, 5-iodouracil, 3-(aminoallyl)uracil for uracil, and inosine for guanosine in sense and antisense strands of the siRNA, and found that whereas 4-thiouracil and 5-bromouracil were all well tolerated, inosine "produced a substantial decrease in interference activity" when incorporated in either strand. Incorporation of 5-iodouracil and 3-(aminoallyl)uracil in the antisense strand resulted in substantial decrease in RNAi activity as well.

Beach et al., WO 01/68836, describes specific methods for attenuating gene expression using endogenously derived dsRNA. Tuschl et al., WO 01/75164, describes a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due "to the danger of activating interferon response". Li et al., WO 00/44914, describes the use of specific dsRNAs for use in attenuating the expression of certain target genes. Zernicka-Goetz et al., WO 01/36646, describes certain methods for inhibiting the expression of particular genes in mammalian cells using certain dsRNA molecules. Fire et al., WO 99/32619, U.S. Pat. No. 6,506,559, the contents of which are hereby incorporated by reference in their entirety, describes particular methods for introducing certain dsRNA molecules into cells for use in inhibiting gene expression. Plaetinck et al., WO 00/01846, describes certain methods for identifying specific genes responsible for conferring a particular phenotype in a cell using specific dsRNA molecules. Mello et al., WO 01/29058, describes the identification of specific genes involved in dsRNA mediated RNAi. Deschamps Depaillette et al., International PCT Publication No. WO 99/07409, describes specific compositions consisting of particular dsRNA molecules combined with certain anti-viral agents. Driscoll et al., International PCT Publication No. WO 01/49844, describes specific DNA constructs for use in facilitating gene silencing in targeted organisms. Parrish et al., 2000, Molecular Cell, 6, 1977-1087, describes specific chemically modified siRNA constructs targeting the unc-22 gene of *C. elegans*. Tuschl et al., International PCT Publication No. WO 02/44321, describe certain synthetic siRNA constructs.

Methods for Using Nucleic Acid Molecules as Probes and Primers

The isolated nucleic acid molecules of the present invention can be used as hybridization probes to detect, characterize, and quantify hybridizing nucleic acids in, and isolate hybridizing nucleic acids from, both genomic and transcript-derived nucleic acid samples. When free in solution, such probes are typically, but not invariably, detectably labeled; bound to a substrate, as in a microarray, such probes are typically, but not invariably, unlabeled.

In one embodiment, the isolated nucleic acid molecules of the present invention can be used as probes to detect and characterize gross alterations in the gene of an OSNA, such as deletions, insertions, translocations, and duplications of the OSNA genomic locus through fluorescence in situ hybridization (FISH) to chromosome spreads. See, e.g., Andreeff et al. (eds.), *Introduction to Fluorescence In Situ Hybridization: Principles and Clinical Applications*, John Wiley & Sons (1999). The isolated nucleic acid molecules of the present invention can be used as probes to assess smaller genomic alterations using, e.g., Southern blot detection of restriction fragment length polymorphisms. The isolated nucleic acid molecules of the present invention can be used as probes to isolate genomic clones that include a nucleic acid molecule of the present invention, which thereafter can be restriction mapped and sequenced to identify deletions, insertions, translocations, and substitutions (single nucleotide polymorphisms, SNPs) at the sequence level. Alternatively, detection techniques such as molecular beacons may be used, see Kostrikis et al. *Science* 279:1228-1229 (1998).

The isolated nucleic acid molecules of the present invention can also be used as probes to detect, characterize, and quantify OSNA in, and isolate OSNA from, transcript-derived nucleic acid samples. In one embodiment, the isolated nucleic acid molecules of the present invention can be used as hybridization probes to detect, characterize by length, and quantify mRNA by Northern blot of total or poly-A$^+$-selected RNA samples. In another embodiment, the isolated nucleic acid molecules of the present invention can be used as hybridization probes to detect, characterize by location, and quantify mRNA by in situ hybridization to tissue sections. See, e.g., Schwarchzacher et al., *In Situ Hybridization*, Springer-Verlag New York (2000). In another preferred embodiment, the isolated nucleic acid molecules of the present invention can be used as hybridization probes to measure the representation of clones in a cDNA library or to isolate hybridizing nucleic acid molecules acids from cDNA libraries, permitting sequence level characterization of mRNAs that hybridize to OSNAs, including, without limitations, identification of deletions, insertions, substitutions, truncations, alternatively spliced forms and single nucleotide polymorphisms. In yet another preferred embodiment, the nucleic acid molecules of the instant invention may be used in microarrays.

All of the aforementioned probe techniques are well within the skill in the art, and are described at greater length in standard texts such as Sambrook (2001), supra; Ausubel (1999), supra; and Walker et al. (eds.), *The Nucleic Acids Protocols Handbook*, Humana Press (2000).

In another embodiment, a nucleic acid molecule of the invention may be used as a probe or primer to identify and/or amplify a second nucleic acid molecule that selectively hybridizes to the nucleic acid molecule of the invention. In this embodiment, it is preferred that the probe or primer be derived from a nucleic acid molecule encoding an OSP. More preferably, the probe or primer is derived from a nucleic acid molecule encoding a polypeptide having an amino acid sequence of SEQ ID NO: 129-295. Also preferred are probes or primers derived from an OSNA. More preferred are probes or primers derived from a nucleic acid molecule having a nucleotide sequence of SEQ ID NO: 1-128.

In general, a probe or primer is at least 10 nucleotides in length, more preferably at least 12, more preferably at least 14 and even more preferably at least 16 or 17 nucleotides in length. In an even more preferred embodiment, the probe or primer is at least 18 nucleotides in length, even more preferably at least 20 nucleotides and even more preferably at least 22 nucleotides in length. Primers and probes may also be longer in length. For instance, a probe or primer may be 25 nucleotides in length, or may be 30, 40 or 50 nucleotides in length. Methods of performing nucleic acid hybridization using oligonucleotide probes are well known in the art. See, e.g., Sambrook et al., 1989, supra, Chapter 11 and pp. 11.31-11.32 and 11.40-11.44, which describes radiolabeling of short probes, and pp. 11.45-11.53, which describe hybridization conditions for oligonucleotide probes, including specific conditions for probe hybridization (pp. 11.50-11.51).

Methods of performing primer-directed amplification are also well known in the art. Methods for performing the polymerase chain reaction (PCR) are compiled, inter alia, in McPherson, *PCR Basics: From Background to Bench*, Springer Verlag (2000); Innis et al. (eds.), *PCR Applications: Protocols for Functional Genomics*, Academic Press (1999); Gelfand et al. (eds.), *PCR Strategies*, Academic Press (1998); Newton et al., *PCR*, Springer-Verlag New York (1997); Burke (ed.), *PCR: Essential Techniques*, John Wiley & Son Ltd (1996); White (ed.), *PCR Cloning Protocols: From Molecular Cloning to Genetic Engineering*, Vol. 67, Humana Press (1996); and McPherson et al. (eds.), *PCR 2: A Practical Approach*, Oxford University Press, Inc. (1995). Methods for performing RT-PCR are collected, e.g., in Siebert et al. (eds.), *Gene Cloning and Analysis by RT-PCR*, Eaton Publishing Company/Bio Techniques Books Division, 1998; and Siebert (ed.), *PCR Technique: RT-PCR*, Eaton Publishing Company/BioTechniques Books (1995).

PCR and hybridization methods may be used to identify and/or isolate nucleic acid molecules of the present invention including allelic variants, homologous nucleic acid molecules and fragments. PCR and hybridization methods may also be used to identify, amplify and/or isolate nucleic acid molecules of the present invention that encode homologous proteins, analogs, fusion proteins or muteins of the invention. Nucleic acid primers as described herein can be used to prime amplification of nucleic acid molecules of the invention, using transcript-derived or genomic DNA as the template.

These nucleic acid primers can also be used, for example, to prime single base extension (SBE) for SNP detection (See, e.g., U.S. Pat. No. 6,004,744, the disclosure of which is incorporated herein by reference in its entirety).

Isothermal amplification approaches, such as rolling circle amplification, are also now well-described. See, e.g., Schweitzer et al., *Curr. Opin. Biotechnol.* 12(1): 21-7 (2001); International Patent publications WO 97/19193 and WO 00/15779, and U.S. Pat. Nos. 5,854,033 and 5,714,320, the disclosures of which are incorporated herein by reference in their entireties. Rolling circle amplification can be combined with other techniques to facilitate SNP detection. See, e.g., Lizardi et al., *Nature Genet.* 19(3): 225-32 (1998).

Nucleic acid molecules of the present invention may be bound to a substrate either covalently or noncovalently. The substrate can be porous or solid, planar or non-planar, unitary or distributed. The bound nucleic acid molecules may be used as hybridization probes, and may be labeled or unlabeled. In a preferred embodiment, the bound nucleic acid molecules are unlabeled.

In one embodiment, the nucleic acid molecule of the present invention is bound to a porous substrate, e.g., a membrane, typically comprising nitrocellulose, nylon, or positively charged derivatized nylon. The nucleic acid molecule of the present invention can be used to detect a hybridizing nucleic acid molecule that is present within a labeled nucleic acid sample, e.g., a sample of transcript-derived nucleic acids. In another embodiment, the nucleic acid molecule is bound to a solid substrate, including, without limitation, glass, amorphous silicon, crystalline silicon or plastics. Examples of plastics include, without limitation, polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof. The solid substrate may be any shape, including rectangular, disk-like and spherical. In a preferred embodiment, the solid substrate is a microscope slide or slide-shaped substrate.

The nucleic acid molecule of the present invention can be attached covalently to a surface of the support substrate or applied to a derivatized surface in a chaotropic agent that facilitates denaturation and adherence by presumed noncovalent interactions, or some combination thereof. The nucleic acid molecule of the present invention can be bound to a substrate to which a plurality of other nucleic acids are concurrently bound, hybridization to each of the plurality of bound nucleic acids being separately detectable. At low density, e.g. on a porous membrane, these substrate-bound collections are typically denominated macroarrays; at higher density, typically on a solid support, such as glass, these substrate bound collections of plural nucleic acids are colloquially termed microarrays. As used herein, the term microarray includes arrays of all densities. It is, therefore, another aspect of the invention to provide microarrays that comprise one or more of the nucleic acid molecules of the present invention.

In yet another embodiment, the invention is directed to single exon probes based on the OSNAs disclosed herein.

Expression Vectors, Host Cells and Recombinant Methods of Producing Polypeptides Another aspect of the present invention provides vectors that comprise one or more of the isolated nucleic acid molecules of the present invention, and host cells in which such vectors have been introduced.

The vectors can be used, inter alia, for propagating the nucleic acid molecules of the present invention in host cells (cloning vectors), for shuttling the nucleic acid molecules of the present invention between host cells derived from disparate organisms (shuttle vectors), for inserting the nucleic acid molecules of the present invention into host cell chromosomes (insertion vectors), for expressing sense or antisense RNA transcripts of the nucleic acid molecules of the present invention in vitro or within a host cell, and for expressing polypeptides encoded by the nucleic acid molecules of the present invention, alone or as fusion proteins with heterologous polypeptides (expression vectors). Vectors are by now well known in the art, and are described, inter alia, in Jones et al. (eds.), *Vectors: Cloning Applications: Essential Techniques* (Essential Techniques Series), John Wiley & Son Ltd. (1998); Jones et al. (eds.), *Vectors: Expression Systems: Essential Techniques* (Essential Techniques Series), John Wiley & Son Ltd. (1998); Gacesa et al., *Vectors: Essential Data*, John Wiley & Sons Ltd. (1995); Cid-Arregui (eds.), Viral *Vectors: Basic Science and Gene Therapy*, Eaton Publishing Co. (2000); Sambrook (2001), supra; Ausubel (1999), supra. Furthermore, a variety of vectors are available commercially. Use of existing vectors and modifications thereof are well within the skill in the art. Thus, only basic features need be described here.

Nucleic acid sequences may be expressed by operatively linking them to an expression control sequence in an appropriate expression vector and employing that expression vector to transform an appropriate unicellular host. Expression control sequences are sequences that control the transcription, post-transcriptional events and translation of nucleic acid sequences. Such operative linking of a nucleic acid sequence of this invention to an expression control sequence, of course, includes, if not already part of the nucleic acid sequence, the provision of a translation initiation codon, ATG or GTG, in the correct reading frame upstream of the nucleic acid sequence.

A wide variety of host/expression vector combinations may be employed in expressing the nucleic acid sequences of this invention. Useful expression vectors, for example, may consist of segments of chromosomal, non-chromosomal and synthetic nucleic acid sequences.

In one embodiment, prokaryotic cells may be used with an appropriate vector. Prokaryotic host cells are often used for cloning and expression. In a preferred embodiment, prokaryotic host cells include *E. coli, Pseudomonas, Bacillus* and *Streptomyces*. In a preferred embodiment, bacterial host cells are used to express the nucleic acid molecules of the instant invention. Useful expression vectors for bacterial hosts include bacterial plasmids, such as those from *E. coli, Bacillus* or *Streptomyces*, including pBluescript, pGEX-2T, pUC vectors, col E1, pCR1, pBR322, pMB9 and their derivatives, wider host range plasmids, such as RP4, phage DNAs, e.g., the numerous derivatives of phage lambda, e.g., NM989, λGT10 and λGT11, and other phages, e.g., M13 and filamentous single-stranded phage DNA. Where *E. coli* is used as host, selectable markers are, analogously, chosen for selectivity in gram negative bacteria: e.g., typical markers confer resistance to antibiotics, such as ampicillin, tetracycline, chloramphenicol, kanamycin, streptomycin and zeocin; auxotrophic markers can also be used.

In other embodiments, eukaryotic host cells, such as yeast, insect, mammalian or plant cells, may be used. Yeast cells, typically *S. cerevisiae*, are useful for eukaryotic genetic studies, due to the ease of targeting genetic changes by homologous recombination and the ability to easily complement genetic defects using recombinantly expressed proteins. Yeast cells are useful for identifying interacting protein components, e.g. through use of a two-hybrid system. In a preferred embodiment, yeast cells are useful for protein expression. Vectors of the present invention for use in yeast will typically, but not invariably, contain an origin of replication suitable for use in yeast and a selectable marker that is functional in yeast. Yeast vectors include Yeast Integrating plasmids (e.g., YIp5) and Yeast Replicating plasmids (the YRp and YEp series plasmids), Yeast Centromere plasmids (the YCp series plasmids), Yeast Artificial Chromosomes (YACs) which are based on yeast linear plasmids, denoted YLp, pGPD-2, 2μ plasmids and derivatives thereof, and improved shuttle vectors such as those described in Gietz et al., *Gene*, 74: 527-34 (1988) (YIplac, YEplac and YCplac). Selectable markers in yeast vectors include a variety of auxotrophic markers, the most common of which are (in *Saccharomyces cerevisiae*) URA3, HIS3, LEU2, TRP1 and LYS2, which complement specific auxotrophic mutations, such as ura3-52, his3-D1, leu2-D1, trp1-D1 and lys2-201.

Insect cells may be chosen for high efficiency protein expression. Where the host cells are from *Spodoptera frugiperda*, e.g., Sf9 and Sf21 cell lines, and expresSF™ cells (Protein Sciences Corp., Meriden, Conn., USA), the vector replicative strategy is typically based upon the baculovirus life cycle. Typically, baculovirus transfer vectors are used to replace the wild-type AcMNPV polyhedrin gene with a heterologous gene of interest. Sequences that flank the polyhedrin gene in the wild-type genome are positioned 5' and 3' of the expression cassette on the transfer vectors. Following co-transfection with AcMNPV DNA, a homologous recombination event occurs between these sequences resulting in a recombinant virus carrying the gene of interest and the polyhedrin or p10 promoter. Selection can be based upon visual screening for lacZ fusion activity.

The host cells may also be mammalian cells, which are particularly useful for expression of proteins intended as pharmaceutical agents, and for screening of potential agonists and antagonists of a protein or a physiological pathway. Mammalian vectors intended for autonomous extrachromosomal replication will typically include a viral origin, such as the SV40 origin (for replication in cell lines expressing the large T-antigen, such as COS1 and COS7 cells), the papillomavirus origin, or the EBV origin for long term episomal replication (for use, e.g., in 293-EBNA cells, which constitutively express the EBV EBNA-1 gene product and adenovirus E1A). Vectors intended for integration, and thus replication as part of the mammalian chromosome, can, but need not, include an origin of replication functional in mammalian cells, such as the SV40 origin. Vectors based upon viruses, such as adenovirus, adeno-associated virus, vaccinia virus, and various mammalian retroviruses, will typically replicate according to the viral replicative strategy. Selectable markers for use in mammalian cells include, but are not limited to, resistance to neomycin (G418), blasticidin, hygromycin and zeocin, and selection based upon the purine salvage pathway using HAT medium.

Expression in mammalian cells can be achieved using a variety of plasmids, including pSV2, pBC12BI, and p91023, as well as lytic virus vectors (e.g., vaccinia virus, adeno virus, and baculovirus), episomal virus vectors (e.g., bovine papillomavirus), and retroviral vectors (e.g., murine retroviruses). Useful vectors for insect cells include baculoviral vectors and pVL 941.

Plant cells can also be used for expression, with the vector replicon typically derived from a plant virus (e.g., cauliflower mosaic virus, CaMV; tobacco mosaic virus, TMV) and selectable markers chosen for suitability in plants.

It is known that codon usage of different host cells may be different. For example, a plant cell and a human cell may exhibit a difference in codon preference for encoding a particular amino acid. As a result, human mRNA may not be efficiently translated in a plant, bacteria or insect host cell. Therefore, another embodiment of this invention is directed to codon optimization. The codons of the nucleic acid molecules of the invention may be modified to resemble, as much as possible, genes naturally contained within the host cell without altering the amino acid sequence encoded by the nucleic acid molecule.

Any of a wide variety of expression control sequences may be used in these vectors to express the nucleic acid molecules of this invention. Such useful expression control sequences include the expression control sequences associated with structural genes of the foregoing expression vectors. Expression control sequences that control transcription include, e.g., promoters, enhancers and transcription termination sites. Expression control sequences in eukaryotic cells that control post-transcriptional events include splice donor and acceptor sites and sequences that modify the half-life of the transcribed RNA, e.g., sequences that direct poly(A) addition or binding sites for RNA-binding proteins. Expression control sequences that control translation include ribosome binding sites, sequences which direct targeted expression of the polypeptide to or within particular cellular compartments, and sequences in the 5' and 3' untranslated regions that modify the rate or efficiency of translation.

Examples of useful expression control sequences for a prokaryote, e.g., *E. coli*, will include a promoter, often a phage promoter, such as phage lambda pL promoter, the trc promoter, a hybrid derived from the trp and lac promoters, the bacteriophage T7 promoter (in *E. coli* cells engineered to express the T7 polymerase), the TAC or TRC system, the major operator and promoter regions of phage lambda, the control regions of fd coat protein, and the araBAD operon. Prokaryotic expression vectors may further include transcription terminators, such as the aspA terminator, and elements that facilitate translation, such as a consensus ribosome binding site and translation termination codon, Schomer et al., *Proc. Natl. Acad. Sci. USA* 83: 8506-8510 (1986).

Expression control sequences for yeast cells, typically *S. cerevisiae*, will include a yeast promoter, such as the CYC1 promoter, the GAL1 promoter, the GAL10 promoter, ADH1 promoter, the promoters of the yeast α-mating system, or the GPD promoter, and will typically have elements that facilitate transcription termination, such as the transcription termination signals from the CYC1 or ADH1 gene.

Expression vectors useful for expressing proteins in mammalian cells will include a promoter active in mammalian cells. These promoters include, but are not limited to, those derived from mammalian viruses, such as the enhancer-promoter sequences from the immediate early gene of the human cytomegalovirus (CMV), the enhancer-promoter sequences from the Rous sarcoma virus long terminal repeat (RSV LTR), the enhancer-promoter from SV40 and the early and late promoters of adenovirus. Other expression control sequences include the promoter for 3-phosphoglycerate kinase or other glycolytic enzymes, the promoters of acid phosphatase. Other expression control sequences include those from the gene comprising the OSNA of interest. Often, expression is enhanced by incorporation of polyadenylation sites, such as the late SV40 polyadenylation site and the polyadenylation signal and transcription termination sequences from the bovine growth hormone (BGH) gene, and ribosome binding sites. Furthermore, vectors can include introns, such as intron II of rabbit β-globin gene and the SV40 splice elements.

Preferred nucleic acid vectors also include a selectable or amplifiable marker gene and means for amplifying the copy number of the gene of interest. Such marker genes are well known in the art. Nucleic acid vectors may also comprise stabilizing sequences (e.g., ori- or ARS-like sequences and telomere-like sequences), or may alternatively be designed to favor directed or non-directed integration into the host cell genome. In a preferred embodiment, nucleic acid sequences of this invention are inserted in frame into an expression vector that allows a high level expression of an RNA which encodes a protein comprising the encoded nucleic acid sequence of interest. Nucleic acid cloning and sequencing methods are well known to those of skill in the art and are described in an assortment of laboratory manuals, including Sambrook (1989), supra, Sambrook (2000), supra; Ausubel (1992), supra; and Ausubel (1999), supra. Product information from manufacturers of biological, chemical and immunological reagents also provide useful information.

Expression vectors may be either constitutive or inducible. Inducible vectors include either naturally inducible promoters, such as the trc promoter, which is regulated by the lac operon, and the pL promoter, which is regulated by tryptophan, the MMTV-LTR promoter, which is inducible by dexamethasone, or can contain synthetic promoters and/or additional elements that confer inducible control on adjacent promoters. Examples of inducible synthetic promoters are the hybrid Plac/ara-1 promoter and the PLtetO-1 promoter. The PLtetO-1 promoter takes advantage of the high expression levels from the PL promoter of phage lambda, but replaces the lambda repressor sites with two copies of operator 2 of the Tn10 tetracycline resistance operon, causing this promoter to be tightly repressed by the Tet repressor protein and induced in response to tetracycline (Tc) and Tc derivatives such as anhydrotetracycline. Vectors may also be inducible because they contain hormone response elements, such as the glucocorticoid response element (GRE) and the estrogen response element (ERE), which can confer hormone inducibility where vectors are used for expression in cells having the respective hormone receptors. To reduce background levels of expression, elements responsive to ecdysone, an insect hormone, can be used instead, with coexpression of the ecdysone receptor.

In one embodiment of the invention, expression vectors can be designed to fuse the expressed polypeptide to small protein tags that facilitate purification and/or visualization. Such tags include a polyhistidine tag that facilitates purification of the fusion protein by immobilized metal affinity chromatography, for example using NiNTA resin (Qiagen Inc., Valencia, Calif., USA) or TALON™ resin (cobalt immobilized affinity chromatography medium, Clontech Labs, Palo Alto, Calif., USA). The fusion protein can include a chitin-binding tag and self-excising intein, permitting chitin-based purification with self-removal of the fused tag (IMPACT™ system, New England Biolabs, Inc., Beverley, Mass., USA). Alternatively, the fusion protein can include a calmodulin-binding peptide tag, permitting purification by calmodulin affinity resin (Stratagene, La Jolla, Calif., USA), or a specifically excisable fragment of the biotin carboxylase carrier protein, permitting purification of in vivo biotinylated protein using an avidin resin and subsequent tag removal (Promega, Madison, Wis., USA). As another useful alternative, the polypeptides of the present invention can be expressed as a fusion to glutathione-S-transferase, the affinity and specificity of binding to glutathione permitting purification using glutathione affinity resins, such as Glutathione-Superflow Resin (Clontech Laboratories, Palo Alto, Calif., USA), with subsequent elution with free glutathione. Other tags include, for example, the Xpress epitope, detectable by anti-Xpress antibody (Invitrogen, Carlsbad, Calif., USA), a myc tag, detectable by anti-myc tag antibody, the V5 epitope, detectable by anti-V5 antibody (Invitrogen, Carlsbad, Calif., USA), FLAG® epitope, detectable by anti-FLAG® antibody (Stratagene, La Jolla, Calif., USA), and the HA epitope, detectable by anti-HA antibody.

For secretion of expressed polypeptides, vectors can include appropriate sequences that encode secretion signals, such as leader peptides. For example, the pSecTag2 vectors (Invitrogen, Carlsbad, Calif., USA) are 5.2 kb mammalian expression vectors that carry the secretion signal from the V-J2-C region of the mouse Ig kappa-chain for efficient secretion of recombinant proteins from a variety of mammalian cell lines.

Expression vectors can also be designed to fuse proteins encoded by the heterologous nucleic acid insert to polypeptides that are larger than purification and/or identification tags. Useful protein fusions include those that permit display of the encoded protein on the surface of a phage or cell, fusions to intrinsically fluorescent proteins, such as those that have a green fluorescent protein (GFP)-like chromophore, fusions to the IgG Fc region, and fusions for use in two hybrid systems.

Vectors for phage display fuse the encoded polypeptide to, e.g., the gene III protein (pIII) or gene VIII protein (pVIII) for display on the surface of filamentous phage, such as M13. See Barbas et al., *Phage Display: A Laboratory Manual*, Cold Spring Harbor Laboratory Press (2001); Kay et al. (eds.), *Phage Display of Peptides and Proteins: A Laboratory Manual*, Academic Press, Inc., (1996); Abelson et al. (eds.), *Combinatorial Chemistry* (Methods in Enzymology, Vol. 267) Academic Press (1996). Vectors for yeast display, e.g. the pYD1 yeast display vector (Invitrogen, Carlsbad, Calif., USA), use the α-agglutinin yeast adhesion receptor to display recombinant protein on the surface of *S. cerevisiae*. Vectors for mammalian display, e.g., the pDisplay™ vector (Invitrogen, Carlsbad, Calif., USA), target recombinant proteins using an N-terminal cell surface targeting signal and a C-terminal transmembrane anchoring domain of platelet derived growth factor receptor.

A wide variety of vectors now exist that fuse proteins encoded by heterologous nucleic acids to the chromophore of the substrate-independent, intrinsically fluorescent green fluorescent protein from *Aequorea victoria* ("GFP") and its variants. The GFP-like chromophore can be selected from GFP-like chromophores found in naturally occurring proteins, such as *A. victoria* GFP (GenBank accession number AAA27721), *Renilla reniformis* GFP, FP583 (GenBank accession no. AF168419) (DsRed), FP593 (AF272711), FP483 (AF168420), FP484 (AF168424), FP595 (AF246709), FP486 (AF168421), FP538 (AF168423), and FP506 (AF168422), and need include only so much of the native protein as is needed to retain the chromophore's intrinsic fluorescence. Methods for determining the minimal domain required for fluorescence are known in the art. See Li et al., *J. Biol. Chem.* 272: 28545-28549 (1997). Alternatively, the GFP-like chromophore can be selected from GFP-like chromophores modified from those found in nature. The methods for engineering such modified GFP-like chromophores and testing them for fluorescence activity, both alone and as part of protein fusions, are well known in the art. See Heim et al., *Curr. Biol.* 6: 178-182 (1996) and Palm et al., *Methods Enzymol.* 302: 378-394 (1999). A variety of such modified chromophores are now commercially available and can readily be used in the fusion proteins of the present invention. These include EGFP ("enhanced GFP"), EBFP ("enhanced blue fluorescent protein"), BFP2, EYFP ("enhanced yellow fluorescent protein"), ECFP ("enhanced cyan fluorescent protein") or Citrine. EGFP (see, e.g, Cormack et al., *Gene* 173: 33-38 (1996); U.S. Pat. Nos. 6,090,919 and 5,804,387, the disclosures of which are incorporated herein by reference in their entireties) is found on a variety of vectors, both plasmid and viral, which are available commercially (Clontech Labs, Palo Alto, Calif., USA); EBFP is optimized for expression in mammalian cells whereas BFP2, which retains the original jellyfish codons, can be expressed in bacteria (see, e.g., Heim et al., *Curr. Biol.* 6: 178-182 (1996) and Cormack et al., *Gene* 173: 33-38 (1996)). Vectors containing these blue-shifted variants are available from Clontech Labs (Palo Alto, Calif., USA). Vectors containing EYFP, ECFP (see, e.g., Heim et al., *Curr. Biol.* 6: 178-182 (1996); Miyawaki et al., *Nature* 388: 882-887 (1997)) and Citrine (see, e.g., Heikal et al., *Proc. Natl. Acad. Sci. USA* 97: 11996-12001 (2000)) are also available from Clontech Labs.

The GFP-like chromophore can also be drawn from other modified GFPs, including those described in U.S. Pat. Nos. 6,124,128; 6,096,865; 6,090,919; 6,066,476; 6,054,321; 6,027,881; 5,968,750; 5,874,304; 5,804,387; 5,777,079; 5,741,668; and 5,625,048, the disclosures of which are incorporated herein by reference in their entireties. See also Conn (ed.), Green Fluorescent Protein (Methods in Enzymology, Vol. 302), Academic Press, Inc. (1999); Yang, et al., J Biol Chem, 273: 8212-6 (1998); Bevis et al., Nature Biotechnology, 20:83-7 (2002). The GFP-like chromophore of each of these GFP variants can usefully be included in the fusion proteins of the present invention.

Fusions to the IgG Fc region increase serum half-life of protein pharmaceutical products through interaction with the FcRn receptor (also denominated the FcRp receptor and the Brambell receptor, FcRb), further described in International Patent Application Nos. WO 97/43316, WO 97/34631, WO 96/32478, and WO 96/18412, the disclosures of which are incorporated herein by reference in their entireties.

For long-term, high-yield recombinant production of the polypeptides of the present invention, stable expression is preferred. Stable expression is readily achieved by integration into the host cell genome of vectors having selectable markers, followed by selection of these integrants. Vectors such as pUB6/V5-His A, B, and C (Invitrogen, Carlsbad, Calif., USA) are designed for high-level stable expression of heterologous proteins in a wide range of mammalian tissue types and cell lines. pUB6/V5-His uses the promoter/enhancer sequence from the human ubiquitin C gene to drive expression of recombinant proteins: expression levels in 293, CHO, and NIH3T3 cells are comparable to levels from the CMV and human EF-1a promoters. The bsd gene permits rapid selection of stably transfected mammalian cells with the potent antibiotic blasticidin.

Replication incompetent retroviral vectors, typically derived from Moloney murine leukemia virus, also are useful for creating stable transfectants having integrated provirus. The highly efficient transduction machinery of retroviruses, coupled with the availability of a variety of packaging cell lines such as RetroPack™ PT 67, EcoPack2™-293, AmphoPack-293, and GP2-293 cell lines (all available from Clontech Laboratories, Palo Alto, Calif., USA) allow a wide host range to be infected with high efficiency; varying the multiplicity of infection readily adjusts the copy number of the integrated provirus.

Of course, not all vectors and expression control sequences will function equally well to express the nucleic acid molecules of this invention. Neither will all hosts function equally well with the same expression system. However, one of skill in the art may make a selection among these vectors, expression control sequences and hosts without undue experimentation and without departing from the scope of this invention. For example, in selecting a vector, the host must be considered because the vector must be replicated in it. The vector's copy number, the ability to control that copy number, the ability to control integration, if any, and the expression of any other proteins encoded by the vector, such as an antibiotic or other selection marker, should also be considered. The present invention further includes host cells comprising the vectors of the present invention, either present episomally within the cell or integrated, in whole or in part, into the host cell chromosome. Among other considerations, some of which are described above, a host cell strain may be chosen for its ability to process the expressed polypeptide in the desired fashion. Such post-translational modifications of the polypeptide include, but are not limited to, acetylation, carboxylation, glycosylation, phosphorylation, lipidation, and acylation, and it is an aspect of the present invention to provide OSPs with such post-translational modifications.

In selecting an expression control sequence, a variety of factors should also be considered. These include, for example, the relative strength of the sequence, its controllability, and its compatibility with the nucleic acid molecules of this invention, particularly with regard to potential secondary structures. Unicellular hosts should be selected by consideration of their compatibility with the chosen vector, the toxicity of the product coded for by the nucleic acid sequences of this invention, their secretion characteristics, their ability to fold the polypeptide correctly, their fermentation or culture requirements, and the ease of purification from them of the products coded for by the nucleic acid molecules of this invention.

The recombinant nucleic acid molecules and more particularly, the expression vectors of this invention may be used to express the polypeptides of this invention as recombinant polypeptides in a heterologous host cell. The polypeptides of this invention may be full-length or less than full-length polypeptide fragments recombinantly expressed from the nucleic acid molecules according to this invention. Such polypeptides include analogs, derivatives and muteins that may or may not have biological activity.

Vectors of the present invention will also often include elements that permit in vitro transcription of RNA from the inserted heterologous nucleic acid. Such vectors typically include a phage promoter, such as that from T7, T3, or SP6, flanking the nucleic acid insert. Often two different such promoters flank the inserted nucleic acid, permitting separate in vitro production of both sense and antisense strands.

Transformation and other methods of introducing nucleic acids into a host cell (e.g., conjugation, protoplast transformation or fusion, transfection, electroporation, liposome delivery, membrane fusion techniques, high velocity DNA-coated pellets, viral infection and protoplast fusion) can be accomplished by a variety of methods which are well known in the art (See, for instance, Ausubel, supra, and Sambrook et al., supra). Bacterial, yeast, plant or mammalian cells are transformed or transfected with an expression vector, such as a plasmid, a cosmid, or the like, wherein the expression vector comprises the nucleic acid of interest. Alternatively, the cells may be infected by a viral expression vector comprising the nucleic acid of interest. Depending upon the host cell, vector, and method of transformation used, transient or stable expression of the polypeptide will be constitutive or inducible. One having ordinary skill in the art will be able to decide whether to express a polypeptide transiently or stably, and whether to express the protein constitutively or inducibly.

A wide variety of unicellular host cells are useful in expressing the DNA sequences of this invention. These hosts may include well known eukaryotic and prokaryotic hosts, such as strains of, fungi, yeast, insect cells such as Spodoptera frugiperda (SF9), animal cells such as CHO, as well as plant cells in tissue culture. Representative examples of appropriate host cells include, but are not limited to, bacterial cells, such as E. coli, Caulobacter crescentus, Streptomyces species, and Salmonella typhimurium; yeast cells, such as Saccharomyces cerevisiae, Schizosaccharomyces pombe, Pichia pastoris, Pichia methanolica; insect cell lines, such as those from Spodoptera frugiperda, e.g., Sf9 and Sf21 cell lines, and expresSF™ cells (Protein Sciences Corp., Meriden, Conn., USA), Drosophila S2 cells, and Trichoplusia ni High Five® Cells (Invitrogen, Carlsbad, Calif., USA); and mammalian cells. Typical mammalian cells include BHK cells, BSC 1 cells, BSC 40 cells, BMT 10 cells, VERO cells, COS1 cells, COS7 cells, Chinese hamster ovary (CHO) cells, 3T3 cells, NIH 3T3 cells, 293 cells, HEPG2 cells, HeLa cells, L cells, MDCK cells, HEK293 cells, WI38 cells, murine ES cell lines (e.g., from strains 129/SV, C57/BL6, DBA-1, 129/SVJ), K562 cells, Jurkat cells, and BW5147 cells. Other mammalian cell lines are well known and readily available from the American Type Culture Collection (ATCC) (Manassas, Va., USA) and the National Institute of General Medical Sciences (NIGMS) Human Genetic Cell Repository at the Coriell Cell Repositories (Camden, N.J., USA). Cells or cell lines derived from ovarian are particularly preferred because they may provide a more native post-translational processing. Particularly preferred are human ovarian cells.

Particular details of the transfection, expression and purification of recombinant proteins are well documented and are understood by those of skill in the art. Further details on the various technical aspects of each of the steps used in recombinant production of foreign genes in bacterial cell expression systems can be found in a number of texts and laboratory manuals in the art. See, e.g., Ausubel (1992), supra, Ausubel (1999), supra, Sambrook (1989), supra, and Sambrook (2001), supra.

Methods for introducing the vectors and nucleic acid molecules of the present invention into the host cells are well known in the art; the choice of technique will depend primarily upon the specific vector to be introduced and the host cell chosen.

Nucleic acid molecules and vectors may be introduced into prokaryotes, such as $E.$ $coli$, in a number of ways. For instance, phage lambda vectors will typically be packaged using a packaging extract (e.g., Gigapack® packaging extract, Stratagene, La Jolla, Calif., USA), and the packaged virus used to infect $E.$ $coli.$ Plasmid vectors will typically be introduced into chemically competent or electrocompetent bacterial cells. $E.$ $coli$ cells can be rendered chemically competent by treatment, e.g., with $CaCl_2$, or a solution of $Mg^{2+}$, $Mn^{2+}$, $Ca^{2+}$, $R^+$ or $K^+$, dimethyl sulfoxide, dithiothreitol, and hexamine cobalt (III), Hanahan, $J.$ $Mol.$ $Biol.$ 166(4):557-80 (1983), and vectors introduced by heat shock. A wide variety of chemically competent strains are also available commercially (e.g., Epicurian Coli® XL10-Gold® Ultracompetent Cells (Stratagene, La Jolla, Calif., USA); DH5α competent cells (Clontech Laboratories, Palo Alto, Calif., USA); and TOP10 Chemically Competent $E.$ $coli$ Kit (Invitrogen, Carlsbad, Calif., USA)). Bacterial cells can be rendered electrocompetent to take up exogenous DNA by electroporation by various pre-pulse treatments; vectors are introduced by electroporation followed by subsequent outgrowth in selected media. An extensive series of protocols is provided by BioRad (Richmond, Calif., USA).

Vectors can be introduced into yeast cells by spheroplasting, treatment with lithium salts, electroporation, or protoplast fusion. Spheroplasts are prepared by the action of hydrolytic enzymes such as a snail-gut extract, usually denoted Glusulase or Zymolyase, or an enzyme from $Arthrobacter$ $luteus$ to remove portions of the cell wall in the presence of osmotic stabilizers, typically 1 M sorbitol. DNA is added to the spheroplasts, and the mixture is co-precipitated with a solution of polyethylene glycol (PEG) and $Ca^{2+}$. Subsequently, the cells are resuspended in a solution of sorbitol, mixed with molten agar and then layered on the surface of a selective plate containing sorbitol.

For lithium-mediated transformation, yeast cells are treated with lithium acetate to permeabilize the cell wall, DNA is added and the cells are co-precipitated with PEG. The cells are exposed to a brief heat shock, washed free of PEG and lithium acetate, and subsequently spread on plates containing ordinary selective medium. Increased frequencies of transformation are obtained by using specially-prepared single-stranded carrier DNA and certain organic solvents. Schiestl et al., $Curr.$ $Genet.$ 16(5-6): 339-46 (1989).

For electroporation, freshly-grown yeast cultures are typically washed, suspended in an osmotic protectant, such as sorbitol, mixed with DNA, and the cell suspension pulsed in an electroporation device. Subsequently, the cells are spread on the surface of plates containing selective media. Becker et al., $Methods$ $Enzymol.$ 194: 182-187 (1991). The efficiency of transformation by electroporation can be increased over 100-fold by using PEG, single-stranded carrier DNA and cells that are in late log-phase of growth. Larger constructs, such as YACs, can be introduced by protoplast fusion.

Mammalian and insect cells can be directly infected by packaged viral vectors, or transfected by chemical or electrical means. For chemical transfection, DNA can be coprecipitated with $CaPO_4$ or introduced using liposomal and nonliposomal lipid-based agents. Commercial kits are available for $CaPO_4$ transfection (CalPhos™ Mammalian Transfection Kit, Clontech Laboratories, Palo Alto, Calif., USA), and lipid-mediated transfection can be practiced using commercial reagents, such as LIPOFECTAMINE™ 2000, LIPOFECTAMINE™ Reagent, CELLFECTIN® Reagent, and LIPOFECTIN® Reagent (Invitrogen, Carlsbad, Calif., USA), DOTAP Liposomal Transfection Reagent, FuGENE 6, X-tremeGENE Q2, DOSPER, (Roche Molecular Biochemicals, Indianapolis, Ind. USA), Effectene™, PolyFect®, Superfect® (Qiagen, Inc., Valencia, Calif., USA). Protocols for electroporating mammalian cells can be found in, for example, Norton et al. (eds.), $Gene$ $Transfer$ $Methods:$ $Introducing$ $DNA$ $into$ $Living$ $Cells$ $and$ $Organisms$, BioTechniques Books, Eaton Publishing Co. (2000). Other transfection techniques include transfection by particle bombardment and microinjection. See, e.g., Cheng et al., $Proc.$ $Natl.$ $Acad.$ $Sci.$ $USA$ 90(10): 4455-9 (1993); Yang et al., $Proc.$ $Natl.$ $Acad.$ $Sci.$ $USA$ 87(24): 9568-72 (1990).

Production of the recombinantly produced proteins of the present invention can optionally be followed by purification.

Purification of recombinantly expressed proteins is now well within the skill in the art and thus need not be detailed here. See, e.g., Thorner et al. (eds.), $Applications$ $of$ $Chimeric$ $Genes$ $and$ $Hybrid$ $Proteins,$ $Part$ $A:$ $Gene$ $Expression$ $and$ $Protein$ $Purification$ (Methods in Enzymology, Vol. 326), Academic Press (2000); Harbin (ed.), $Cloning,$ $Gene$ $Expression$ $and$ $Protein$ $Purification:$ $Experimental$ $Procedures$ $and$ $Process$ $Rationale$, Oxford Univ. Press (2001); Marshak et al., $Strategies$ $for$ $Protein$ $Purification$ $and$ $Characterization:$ $A$ $Laboratory$ $Course$ $Manual$, Cold Spring Harbor Laboratory Press (1996); and Roe (ed.), $Protein$ $Purification$ $Applications$, Oxford University Press (2001).

Briefly, however, if purification tags have been fused through use of an expression vector that appends such tags, purification can be effected, at least in part, by means appropriate to the tag, such as use of immobilized metal affinity chromatography for polyhistidine tags. Other techniques common in the art include ammonium sulfate fractionation, immunoprecipitation, fast protein liquid chromatography (FPLC), high performance liquid chromatography (HPLC), and preparative gel electrophoresis.

Polypeptides, Including Fragments Muteins, Homologous Proteins, Allelic Variants, Analogs and Derivatives Another aspect of the invention relates to polypeptides encoded by the nucleic acid molecules described herein. In a preferred embodiment, the polypeptide is an ovarian specific polypeptide (OSP). In an even more preferred embodiment, the polypeptide comprises an amino acid sequence of SEQ ID NO:129-295 or is derived from a polypeptide having the amino acid sequence of SEQ ID NO: 129-295. A polypeptide as defined herein may be produced recombinantly, as discussed supra, may be isolated from a cell that naturally expresses the protein, or may be chemically synthesized following the teachings of the specification and using methods well known to those having ordinary skill in the art.

Polypeptides of the present invention may also comprise a part or fragment of an OSP. In a preferred embodiment, the fragment is derived from a polypeptide having an amino acid sequence selected from the group consisting of SEQ ID NO: 129-295. Polypeptides of the present invention comprising a part or fragment of an entire OSP may or may not be OSPs. For example, a full-length polypeptide may be ovarian-specific, while a fragment thereof may be found in other tissues as well as in ovarian. A polypeptide that is not an OSP, whether it is a fragment, analog, mutein, homologous protein or derivative, is nevertheless useful, especially for immunizing animals to prepare anti-OSP antibodies. In a preferred embodiment, the part or fragment is an OSP. Methods of determining whether a polypeptide of the present invention is an OSP are described infra.

Polypeptides of the present invention comprising fragments of at least 6 contiguous amino acids are also useful in mapping B cell and T cell epitopes of the reference protein. See, e.g., Geysen et al., *Proc. Natl. Acad. Sci. USA* 81: 3998-4002 (1984) and U.S. Pat. Nos. 4,708,871 and 5,595,915, the disclosures of which are incorporated herein by reference in their entireties. Because the fragment need not itself be immunogenic, part of an immunodominant epitope, nor even recognized by native antibody, to be useful in such epitope mapping, all fragments of at least 6 amino acids of a polypeptide of the present invention have utility in such a study.

Polypeptides of the present invention comprising fragments of at least 8 contiguous amino acids, often at least 15 contiguous amino acids, are useful as immunogens for raising antibodies that recognize polypeptides of the present invention. See, e.g., Lerner, Nature 299: 592-596 (1982); Shinnick et al., *Annu. Rev. Microbiol.* 37: 425-46 (1983); Sutcliffe et al., *Science* 219: 660-6 (1983). As further described in the above-cited references, virtually all 8-mers, conjugated to a carrier, such as a protein, prove immunogenic and are capable of eliciting antibody for the conjugated peptide; accordingly, all fragments of at least 8 amino acids of the polypeptides of the present invention have utility as immunogens.

Polypeptides comprising fragments of at least 8, 9, 10 or 12 contiguous amino acids are also useful as competitive inhibitors of binding of the entire polypeptide, or a portion thereof, to antibodies (as in epitope mapping), and to natural binding partners, such as subunits in a multimeric complex or to receptors or ligands of the subject protein; this competitive inhibition permits identification and separation of molecules that bind specifically to the polypeptide of interest. See U.S. Pat. Nos. 5,539,084 and 5,783,674, incorporated herein by reference in their entireties.

The polypeptide of the present invention thus preferably is at least 6 amino acids in length, typically at least 8, 9, 10 or 12 amino acids in length, and often at least 15 amino acids in length. Often, the polypeptide of the present invention is at least 20 amino acids in length, even 25 amino acids, 30 amino acids, 35 amino acids, or 50 amino acids or more in length. Of course, larger polypeptides having at least 75 amino acids, 100 amino acids, or even 150 amino acids are also useful, and at times preferred.

One having ordinary skill in the art can produce fragments by truncating the nucleic acid molecule, e.g., an OSNA, encoding the polypeptide and then expressing it recombinantly. Alternatively, one can produce a fragment by chemically synthesizing a portion of the full-length polypeptide. One may also produce a fragment by enzymatically cleaving either a recombinant polypeptide or an isolated naturally occurring polypeptide. Methods of producing polypeptide fragments are well known in the art. See, e.g., Sambrook (1989), supra; Sambrook (2001), supra; Ausubel (1992), supra; and Ausubel (1999), supra. In one embodiment, a polypeptide comprising only a fragment, preferably a fragment of an OSP, may be produced by chemical or enzymatic cleavage of an OSP polypeptide. In a preferred embodiment, a polypeptide fragment is produced by expressing a nucleic acid molecule of the present invention encoding a fragment, preferably of an OSP, in a host cell.

Polypeptides of the present invention are also inclusive of mutants, fusion proteins, homologous proteins and allelic variants.

A mutant protein, or mutein, may have the same or different properties compared to a naturally occurring polypeptide and comprises at least one amino acid insertion, duplication, deletion, rearrangement or substitution compared to the amino acid sequence of a native polypeptide. Small deletions and insertions can often be found that do not alter the function of a protein. Muteins may or may not be ovarian-specific. Preferably, the mutein is ovarian-specific. More preferably the mutein is a polypeptide that comprises at least one amino acid insertion, duplication, deletion, rearrangement or substitution compared to the amino acid sequence of SEQ ID NO: 129-295. Accordingly, in a preferred embodiment, the mutein is one that exhibits at least 50% sequence identity, more preferably at least 60% sequence identity, even more preferably at least 70%, yet more preferably at least 80% sequence identity to an OSP comprising an amino acid sequence of SEQ ID NO: 129-295. In a yet more preferred embodiment, the mutein exhibits at least 85%, more preferably 90%, even more preferably 95% or 96%, and yet more preferably at least 97%, 98%, 99% or 99.5% sequence identity to an OSP comprising an amino acid sequence of SEQ ID NO: 129-295.

A mutein may be produced by isolation from a naturally occurring mutant cell, tissue or organism. A mutein may be produced by isolation from a cell, tissue or organism that has been experimentally mutagenized. Alternatively, a mutein may be produced by chemical manipulation of a polypeptide, such as by altering the amino acid residue to another amino acid residue using synthetic or semi-synthetic chemical techniques. In a preferred embodiment, a mutein is produced from a host cell comprising a mutated nucleic acid molecule compared to the naturally occurring nucleic acid molecule. For instance, one may produce a mutein of a polypeptide by introducing one or more mutations into a nucleic acid molecule of the invention and then expressing it recombinantly. These mutations may be targeted, in which particular encoded amino acids are altered, or may be untargeted, in which random encoded amino acids within the polypeptide are altered. Muteins with random amino acid alterations can be screened for a particular biological activity or property, particularly whether the polypeptide is ovarian-specific, as described below. Multiple random mutations can be introduced into the gene by methods well known to the art, e.g., by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis and site-specific mutagenesis. Methods of producing muteins with targeted or random amino acid alterations are well known in the art. See, e.g., Sambrook (1989), supra; Sambrook (2001), supra; Ausubel (1992), supra; and Ausubel (1999), as well as U.S. Pat. No. 5,223,408, which is herein incorporated by reference in its entirety.

The invention also contemplates polypeptides that are homologous to a polypeptide of the invention. In a preferred embodiment, the polypeptide is homologous to an OSP. In an even more preferred embodiment, the polypeptide is homologous to an OSP selected from the group having an amino acid sequence of SEQ ID NO: 129-295. By homologous polypeptide it is meant one that exhibits significant sequence identity to an OSP, preferably an OSP having an amino acid sequence of SEQ ID NO: 129-295. By significant sequence identity it is meant that the homologous polypeptide exhibits at least 50% sequence identity, more preferably at least 60% sequence identity, even more preferably at least 70%, yet more preferably at least 80% sequence identity to an OSP comprising an amino acid sequence of SEQ ID NO: 129-295. More preferred are homologous polypeptides exhibiting at least 85%, more preferably 90%, even more preferably 95% or 96%, and yet more preferably at least 97% or 98% sequence identity to an OSP comprising an amino acid sequence of SEQ ID NO: 129-295. Most preferably, the homologous polypeptide exhibits at least 99%, more preferably 99.5%, even more preferably 99.6%, 99.7%, 99.8% or 99.9% sequence identity to an OSP comprising an amino acid sequence of SEQ ID NO: 129-295. In a preferred embodiment, the amino acid substitutions of the homologous polypeptide are conservative amino acid substitutions as discussed supra.

Homologous polypeptides of the present invention also comprise polypeptide encoded by a nucleic acid molecule that selectively hybridizes to an OSNA or an antisense sequence thereof. In this embodiment, it is preferred that the homologous polypeptide be encoded by a nucleic acid molecule that hybridizes to an OSNA under low stringency, moderate stringency or high stringency conditions, as defined herein. More preferred is a homologous polypeptide encoded by a nucleic acid sequence which hybridizes to a OSNA selected from the group consisting of SEQ ID NO: 1-128 or a homologous polypeptide encoded by a nucleic acid molecule that hybridizes to a nucleic acid molecule that encodes an OSP, preferably an OSP of SEQ ID NO:129-295 under low stringency, moderate stringency or high stringency conditions, as defined herein.

Homologous polypeptides of the present invention may be naturally occurring and derived from another species, especially one derived from another primate, such as chimpanzee, gorilla, rhesus macaque, or baboon, wherein the homologous polypeptide comprises an amino acid sequence that exhibits significant sequence identity to that of SEQ ID NO: 129-295. The homologous polypeptide may also be a naturally occurring polypeptide from a human, when the OSP is a member of a family of polypeptides. The homologous polypeptide may also be a naturally occurring polypeptide derived from a non-primate, mammalian species, including without limitation, domesticated species, e.g., dog, cat, mouse, rat, rabbit, guinea pig, hamster, cow, horse, goat or pig. The homologous polypeptide may also be a naturally occurring polypeptide derived from a non-mammalian species, such as birds or reptiles. The naturally occurring homologous protein may be isolated directly from humans or other species. Alternatively, the nucleic acid molecule encoding the naturally occurring homologous polypeptide may be isolated and used to express the homologous polypeptide recombinantly. The homologous polypeptide may also be one that is experimentally produced by random mutation of a nucleic acid molecule and subsequent expression of the nucleic acid molecule. Alternatively, the homologous polypeptide may be one that is experimentally produced by directed mutation of one or more codons to alter the encoded amino acid of an OSP. In a preferred embodiment, the homologous polypeptide encodes a polypeptide that is an OSP.

Relatedness of proteins can also be characterized using a second functional test, such as the ability of a first protein competitively to inhibit the binding of a second protein to an antibody. It is, therefore, another aspect of the present invention to provide isolated polypeptides not only identical in sequence to those described with particularity herein, but also to provide isolated polypeptides ("cross-reactive proteins") that competitively inhibit the binding of antibodies to all or to a portion of the isolated polypeptides of the present invention. Such competitive inhibition can readily be determined using immunoassays well known in the art.

As discussed above, single nucleotide polymorphisms (SNPs) occur frequently in eukaryotic genomes, and the sequence determined from one individual of a species may differ from other allelic forms present within the population. Thus, polypeptides of the present invention are also inclusive of those encoded by an allelic variant of a nucleic acid molecule encoding an OSP. In this embodiment, it is preferred that the polypeptide be encoded by an allelic variant of a gene that encodes a polypeptide having the amino acid sequence selected from the group consisting of SEQ ID NO: 129-295. More preferred is that the polypeptide be encoded by an allelic variant of a gene that has the nucleic acid sequence selected from the group consisting of SEQ ID NO: 1-128.

Polypeptides of the present invention are also inclusive of derivative polypeptides encoded by a nucleic acid molecule according to the instant invention. In this embodiment, it is preferred that the polypeptide be an OSP. Also preferred are derivative polypeptides having an amino acid sequence selected from the group consisting of SEQ ID NO: 129-295 and which has been acetylated, carboxylated, phosphorylated, glycosylated, ubiquitinated or post-translationally modified in another manner. In another preferred embodiment, the derivative has been labeled with, e.g., radioactive isotopes such as $^{125}I$, $^{32}P$, $^{35}S$, and $^{3}H$. In another preferred embodiment, the derivative has been labeled with fluorophores, chemiluminescent agents, enzymes, and antiligands that can serve as specific binding pair members for a labeled ligand.

Polypeptide modifications are well known to those of skill and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as, for instance Creighton, *Protein Structure and Molecular Properties,* 2nd ed., W. H. Freeman and Company (1993). Many detailed reviews are available on this subject, such as, for example, those provided by Wold, in Johnson (ed.), *Post-translational Covalent Modification of Proteins*, pgs. 1-12, Academic Press (1983); Seifter et al., *Meth. Enzymol.* 182: 626-646 (1990) and Rattan et al., *Ann. N.Y. Acad. Sci.* 663: 48-62 (1992).

One may determine whether a polypeptide of the invention is likely to be post-translationally modified by analyzing the sequence of the polypeptide to determine if there are peptide motifs indicative of sites for post-translational modification. There are a number of computer programs that permit prediction of post-translational modifications. See, e.g., expasy.org (accessed Nov. 11, 2002) of the world wide web, which includes PSORT, for prediction of protein sorting signals and localization sites, SignalP, for prediction of signal peptide cleavage sites, MITOPROT and Predotar, for prediction of mitochondrial targeting sequences, NetOGlyc, for prediction of type O-glycosylation sites in mammalian proteins, big-PI Predictor and DGPI, for prediction of prenylation-anchor and cleavage sites, and NetPhos, for prediction of Ser, Thr and Tyr phosphorylation sites in eukaryotic proteins. Other computer programs, such as those included in GCG, also may be used to determine post-translational modification peptide motifs.

General examples of types of post-translational modifications include, but are not limited to: (Z)-dehydrobutyrine; 1-chondroitin sulfate-L-aspartic acid ester; 1'-glycosyl-L-tryptophan; 1'-phospho-L-histidine; 1-thioglycine; 2'-(S-L-cysteinyl)-L-histidine; 2'-[3-carboxamido (trimethylammonio)propyl]-L-histidine; 2'-alpha-mannosyl-L-tryptophan; 2-methyl-L-glutamine; 2-oxobutanoic acid; 2-pyrrolidone carboxylic acid; 3'-(1'-L-histidyl)-L-tyrosine; 3'-(8alpha-FAD)-L-histidine; 3'-(S-L-cysteinyl)-L-tyrosine; 3',3",5'-triiodo-L-thyronine; 3'-4'-phospho-L-tyrosine; 3-hydroxy-L-proline; 3'-methyl-L-histidine; 3-methyl-L-lanthionine; 3'-phospho-L-histidine; 4'-(L-tryptophan)-L-tryptophyl quinone; 42 N-cysteinyl-glycosylphosphatidylinositolethanolamine; 43-(T-L-histidyl)-L-tyrosine; 4-hydroxy-L-arginine; 4-hydroxy-L-lysine; 4-hydroxy-L-proline; 5'-(N6-L-lysine)-L-topaquinone; 5-hydroxy-L-lysine; 5-methyl-L-arginine; alpha-1-microglobulin-Ig alpha complex chromophore; bis-L-cysteinyl bis-L-histidino diiron disulfide; bis-L-cysteinyl-L-N3'-histidino-L-serinyl tetrairon' tetrasulfide; chondroitin sulfate D-glucuronyl-D-galactosyl-D-galactosyl-D-xylosyl-L-serine; D-alanine; D-alloisoleucine; D-asparagine; dehydroalanine; dehydrotyrosine; dermatan 4-sulfate D-glucuronyl-D-galactosyl-D-galactosyl-D-xylosyl-L-serine; D-glucuronyl-N-glycine; dipyrrolylmethanemethyl-L-cysteine; D-leucine; D-methionine; D-phenylalanine; D-serine; D-tryptophan; glycine amide; glycine oxazolecarboxylic acid; glycine thiazolecarboxylic acid; heme P450-bis-L-cysteine-L-tyrosine; heme-bis-L-cysteine; hemediol-L-aspartyl ester-L-glutamyl ester; hemediol-L-aspartyl ester-L-glutamyl ester-L-methionine sulfonium; heme-L-cysteine; heme-L-histidine; heparan sulfate D-glucuronyl-D-galactosyl-D-galactosyl-D-xylosyl-L-serine; heme P450-bis-L-cysteine-L-lysine; hexakis-L-cysteinyl hexairon hexasulfide; keratan sulfate D-glucuronyl-D-galactosyl-D-galactosyl-D-xylosyl-L-threonine; L oxoalanine-lactic acid; L phenyllacetic acid; 1'-(8alpha-FAD)-L-histidine; L-2',4',5'-topaquinone; L-3',4'-dihydroxyphenylalanine; L-3',4',5'-trihydroxyphenylalanine; L-4'-bromophenylalanine; L-6'-bromotryptophan; L-alanine amide; L-alanyl imidazolinone glycine; L-allysine; L-arginine amide; L-asparagine amide; L-aspartic 4-phosphoric anhydride; L-aspartic acid 1-amide; L-beta-methylthioaspartic acid; L-bromohistidine; L-citrulline; L-cysteine amide; L-cysteine glutathione disulfide; L-cysteine methyl disulfide; L-cysteine methyl ester; L-cysteine oxazolecarboxylic acid; L-cysteine oxazolinecarboxylic acid; L-cysteine persulfide; L-cysteine sulfenic acid; L-cysteine sulfinic acid; L-cysteine thiazolecarboxylic acid; L-cysteinyl homocitryl molybdenum-heptairon-nonasulfide; L-cysteinyl imidazolinone glycine; L-cysteinyl molybdopterin; L-cysteinyl molybdopterin guanine dinucleotide; L-cystine; L-erythro-beta-hydroxyasparagine; L-erythro-beta-hydroxyaspartic acid; L-gamma-carboxyglutamic acid; L-glutamic acid 1-amide; L-glutamic acid 5-methyl ester; L-glutamine amide; L-glutamyl 5-glycerylphosphorylethanolamine; L-histidine amide; L-isoglutamyl-polyglutamic acid; L-isoglutamyl-polyglycine; L-isoleucine amide; L-lanthionine; L-leucine amide; L-lysine amide; L-lysine thiazolecarboxylic acid; L-lysinoalanine; L-methionine amide; L-methionine sulfone; L-phenyalanine thiazolecarboxylic acid; L-phenylalanine amide; L-proline amide; L-selenocysteine; L-selenocysteinyl molybdopterin guanine dinucleotide; L-serine amide; L-serine thiazolecarboxylic acid; L-seryl imidazolinone glycine; L-T-bromophenylalanine; L-T-bromophenylalanine; L-threonine amide; L-thyroxine; L-tryptophan amide; L-tryptophyl quinone; L-tyrosine amide; L-valine amide; meso-lanthionine; N-(L-glutamyl)-L-tyrosine; N-(L-isoaspartyl)-glycine; N-(L-isoaspartyl)-L-cysteine; N,N,N-trimethyl-L-alanine; N,N-dimethyl-L-proline; N2-acetyl-L-lysine; N2-succinyl-L-tryptophan; N4-(ADP-ribosyl)-L-asparagine; N4-glycosyl-L-asparagine; N4-hydroxymethyl-L-asparagine; N4-methyl-L-asparagine; N5-methyl-L-glutamine; N6-1-carboxyethyl-L-lysine; N6-(4-amino hydroxybutyl)-L-lysine; N6-(L-isoglutamyl)-L-lysine; N6-(phospho-5'-adenosine)-L-lysine; N6-(phospho-5'-guanosine)-L-tysine; N6,N6,N6-trimethyl-L-lysine; N6,N6-dimethyl-L-lysine; N6-acetyl-L-lysine; N6-biotinyl-L-lysine; N6-carboxy-L-lysine; N6-formyl-L-lysine; N6-glycyl-L-lysine; N6-lipoyl-L-lysine; N6-methyl-L-lysine; N6-methyl-N6-poly(N-methyl-propylamine)-L-lysine; N6-mureinyl-L-lysine; N6-myristoyl-L-lysine; N6-palmitoyl-L-lysine; N6-pyridoxal phosphate-L-lysine; N6-pyruvic acid 2-iminyl-L-lysine; N6-retinal-L-lysine; N-acetylglycine; N-acetyl-L-glutamine; N-acetyl-L-alanine; N-acetyl-L-aspartic acid; N-acetyl-L-cysteine; N-acetyl-L-glutamic acid; N-acetyl-L-isoleucine; N-acetyl-L-methionine; N-acetyl-L-proline; N-acetyl-L-serine; N-acetyl-L-threonine; N-acetyl-L-tyrosine; N-acetyl-L-valine; N-alanyl-glycosylphosphatidylinositolethanolamine; N-asparaginyl-glycosylphosphatidylinositolethanolamine; N-aspartyl-glycosylphosphatidylinositolethanolamine; N-formylglycine; N-formyl-L-methionine; N-glycyl-glycosylphosphatidylinositolethanolamine; N-L-glutamyl-poly-L-glutamic acid; N-methylglycine; N-methyl-L-alanine; N-methyl-L-methionine; N-methyl-L-phenylalanine; N-myristoyl-glycine; N-palmitoyl-L-cysteine; N-pyruvic acid 2-iminyl-L-cysteine; N-pyruvic acid 2-iminyl-L-valine; N-seryl-glycosylphosphatidylinositolethanolamine; N-seryl-glycosyOSPhingolipidinositolethanolamine; O-(ADP-ribosyl)-L-serine; O-(phospho-5'-adenosine)-L-threonine; O-(phospho-5'-DNA)-L-serine; O-(phospho-5'-DNA)-L-threonine; O-(phospho-5'rRNA)-L-serine; O-(phosphoribosyl dephospho-coenzyme A)-L-serine; O-(sn-1-glycerophosphoryl)-L-serine; O4'-(8alpha-FAD)-L-tyrosine; O4'-(phospho-5'-adenosine)-L-tyrosine; O4'-(phospho-5'-DNA)-L-tyrosine; O4'-(phospho-5'-RNA)-L-tyrosine; O4'-(phospho-5'-uridine)-L-tyrosine; 04-glycosyl-L-hydroxyproline; O4'-glycosyl-L-tyrosine; O4'-sulfo-L-tyrosine; O5-glycosyl-L-hydroxylysine; O-glycosyl-L-serine; O-glycosyl-L-threonine; omega-N-(ADP-ribosyl)-L-arginine; omega-N-omega-N'-dimethyl-L-arginine; omega-N-methyl-L-arginine; omega-N-omega-N-dimethyl-L-arginine; omega-N-phospho-L-arginine; O'octanoyl-L-serine; O-palmitoyl-L-serine; O-palmitoyl-L-threonine; O-phospho-L-serine; O-phospho-L-threonine; O-phospho-pantetheine-L-serine; phycoerythrobilin-bis-L-cysteine; phycourobilin-bis-L-cysteine; pyrroloquinoline quinone; pyruvic acid; S hydroxycinnamyl-L-cysteine; S-(2-aminovinyl) methyl-D-eysteine; S-(2-aminovinyl)-D-cysteine; S-(6-FW-L-cysteine; S-(8alpha-FAD)-L-cysteine; S-(ADP-ribosyl)-L-cysteine; S-(L-isoglutamyl)-L-cysteine; S-12-hydroxyfarnesyl-L-cysteine; S-acetyl-L-cysteine; S-diacylglycerol-L-cysteine; S-diphytanylglycerot diether-L-cysteine; S-farnesyl-L-cysteine; S-geranylgeranyl-L-cysteine; S-glycosyl-L-cysteine; S-glycyl-L-cysteine; S-methyl-L-cysteine; S-nitrosyl-L-cysteine; S-palmitoyl-L-cysteine;

S-phospho-L-cysteine; S-phycobiliviolin-L-cysteine; S-phycocyanobilin-L-cysteine; S-phycoerythrobilin-L-cysteine; S-phytochromobilin-L-cysteine; S-selenyl-L-cysteine; S-sulfo-L-cysteine; tetrakis-L-cysteinyl diiron disulfide; tetrakis-L-cysteinyl iron; tetrakis-L-cysteinyl tetrairon tetrasulfide; trans-2,3-cis 4-dihydroxy-L-proline; tris-L-cysteinyl triiron tetrasulfide; tris-L-cysteinyl triiron trisulfide; tris-L-cysteinyl-L-aspartato tetrairon tetrasulfide; tris-L-cysteinyl-L-cysteine persulfido-bis-L-glutamato-L-histidino tetrairon disulfide trioxide; tris-L-cysteinyl-L-N3'-histidino tetrairon tetrasulfide; tris-L-cysteinyl-L-N1'-histidino tetrairon tetrasulfide; and tris-L-cysteinyl-L-serinyl tetrairon tetrasulfide.

Additional examples of PTMs may be found in web sites such as the Delta Mass database based on Krishna, R. G. and F. Wold (1998). Posttranslational Modifications. Proteins—Analysis and Design. R. H. Angeletti. San Diego, Academic Press. 1: 121-206; Methods in Enzymology, 193, J. A. McClosky (ed) (1990), pages 647-660; Methods in Protein Sequence Analysis edited by Kazutomo Imahori and Fumio Sakiyama, Plenum Press, (1993) "Post-translational modifications of proteins" R. G. Krishna and F. Wold pages 167-172; "GlycoSuiteDB: a new curated relational database of glycoprotein glycan structures and their biological sources" Cooper et al. Nucleic Acids Res. 29; 332-335 (2001) "O-GLYCBASE version 4.0: a revised database of O-glycosylated proteins" Gupta et al. Nucleic Acids Research, 27: 370-372 (1999); and "PhosphoBase, a database of phosphorylation sites: release 2.0.", Kreegipuu et al. Nucleic Acids Res 27(1):237-239 (1999) see also, WO 02/21139A2, the disclosure of which is incorporated herein by reference in its entirety.

Tumorigenesis is often accompanied by alterations in the post-translational modifications of proteins. Thus, in another embodiment, the invention provides polypeptides from cancerous cells or tissues that have altered post-translational modifications compared to the post-translational modifications of polypeptides from normal cells or tissues. A number of altered post-translational modifications are known. One common alteration is a change in phosphorylation state, wherein the polypeptide from the cancerous cell or tissue is hyperphosphorylated or hypophosphorylated compared to the polypeptide from a normal tissue, or wherein the polypeptide is phosphorylated on different residues than the polypeptide from a normal cell. Another common alteration is a change in glycosylation state, wherein the polypeptide from the cancerous cell or tissue has more or less glycosylation than the polypeptide from a normal tissue, and/or wherein the polypeptide from the cancerous cell or tissue has a different type of glycosylation than the polypeptide from a noncancerous cell or tissue. Changes in glycosylation may be critical because carbohydrate-protein and carbohydrate-carbohydrate interactions are important in cancer cell progression, dissemination and invasion. See, e.g., Barchi, *Curr. Pharm. Des.* 6: 485-501 (2000), Verma, *Cancer Biochem. Biophys.* 14: 151-162 (1994) and Dennis et al., *Bioessays* 5: 412-421 (1999).

Another post-translational modification that may be altered in cancer cells is prenylation. Prenylation is the covalent attachment of a hydrophobic prenyl group (either farnesyl or geranylgeranyl) to a polypeptide. Prenylation is required for localizing a protein to a cell membrane and is often required for polypeptide function. For instance, the Ras superfamily of GTPase signalling proteins must be prenylated for function in a cell. See, e.g., Prendergast et al., *Semin. Cancer Biol.* 10: 443-452 (2000) and Khwaja et al., *Lancet* 355: 741-744 (2000).

Other post-translation modifications that may be altered in cancer cells include, without limitation, polypeptide methylation, acetylation, arginylation or racemization of amino acid residues. In these cases, the polypeptide from the cancerous cell may exhibit either increased or decreased amounts of the post-translational modification compared to the corresponding polypeptides from noncancerous cells.

Other polypeptide alterations in cancer cells include abnormal polypeptide cleavage of proteins and aberrant protein-protein interactions. Abnormal polypeptide cleavage may be cleavage of a polypeptide in a cancerous cell that does not usually occur in a normal cell, or a lack of cleavage in a cancerous cell, wherein the polypeptide is cleaved in a normal cell. Aberrant protein-protein interactions may be either covalent cross-linking or non-covalent binding between proteins that do not normally bind to each other. Alternatively, in a cancerous cell, a protein may fail to bind to another protein to which it is bound in a noncancerous cell. Alterations in cleavage or in protein-protein interactions may be due to over- or underproduction of a polypeptide in a cancerous cell compared to that in a normal cell, or may be due to alterations in post-translational modifications (see above) of one or more proteins in the cancerous cell. See, e.g., Henschen-Edman, *Ann. N.Y. Acad. Sci.* 936: 580-593 (2001).

Alterations in polypeptide post-translational modifications, as well as changes in polypeptide cleavage and protein-protein interactions, may be determined by any method known in the art. For instance, alterations in phosphorylation may be determined by using anti-phosphoserine, anti-phosphothreonine or anti-phosphotyrosine antibodies or by amino acid analysis. Glycosylation alterations may be determined using antibodies specific for different sugar residues, by carbohydrate sequencing, or by alterations in the size of the glycoprotein, which can be determined by, e.g., SDS polyacrylamide gel electrophoresis (PAGE). Other alterations of post-translational modifications, such as prenylation, racemization, methylation, acetylation and arginylation, may be determined by chemical analysis, protein sequencing, amino acid analysis, or by using antibodies specific for the particular post-translational modifications. Changes in protein-protein interactions and in polypeptide cleavage may be analyzed by any method known in the art including, without limitation, non-denaturing PAGE (for non-covalent protein-protein interactions), SDS PAGE (for covalent protein-protein interactions and protein cleavage), chemical cleavage, protein sequencing or immunoassays.

In another embodiment, the invention provides polypeptides that have been post-translationally modified. In one embodiment, polypeptides may be modified enzymatically or chemically, by addition or removal of a post-translational modification. For example, a polypeptide may be glycosylated or deglycosylated enzymatically. Similarly, polypeptides may be phosphorylated using a purified kinase, such as a MAP kinase (e.g, p38, ERK, or JNK) or a tyrosine kinase (e.g., Src or erbB2). A polypeptide may also be modified through synthetic chemistry. Alternatively, one may isolate the polypeptide of interest from a cell or tissue that expresses the polypeptide with the desired post-translational modification. In another embodiment, a nucleic acid molecule encoding the polypeptide of interest is introduced into a host cell that is capable of post-translationally modifying the encoded polypeptide in the desired fashion. If the polypeptide does not contain a motif for a desired post-translational modification, one may alter the post-translational modification by mutating the nucleic acid sequence of a nucleic acid molecule encoding the polypeptide so that it contains a site for the desired post-translational modification. Amino acid sequences that may be post-translationally modified are known in the art. See, e.g., the programs described above on the website expasy.org of the world wide web. The nucleic acid molecule may also be introduced into a host cell that is capable of post-translationally modifying the encoded polypeptide. Similarly, one may delete sites that are post-translationally modified by either mutating the nucleic acid sequence so that the encoded polypeptide does not contain the post-translational modification motif, or by introducing the native nucleic acid molecule into a host cell that is not capable of post-translationally modifying the encoded polypeptide.

It will be appreciated, as is well known and as noted above, that polypeptides are not always entirely linear. For instance, polypeptides may be branched as a result of ubiquitination, and they may be circular, with or without branching, generally as a result of posttranslation events, including natural processing events and events brought about by human manipulation which do not occur naturally. Circular, branched and branched circular polypeptides may be synthesized by non-translation natural processes and by entirely synthetic methods, as well. Modifications can occur anywhere in a polypeptide, including the peptide backbone, the amino acid side-chains and the amino or carboxyl termini. In fact, blockage of the amino or carboxyl group in a polypeptide, or both, by a covalent modification, is common in naturally occurring and synthetic polypeptides and such modifications may be present in polypeptides of the present invention, as well. For instance, the amino terminal residue of polypeptides made in *E. coli*, prior to proteolytic processing, almost invariably will be N-formylmethionine.

Useful post-synthetic (and post-translational) modifications include conjugation to detectable labels, such as fluorophores. A wide variety of amine-reactive and thiol-reactive fluorophore derivatives have been synthesized that react under nondenaturing conditions with N-terminal amino groups and epsilon amino groups of lysine residues, on the one hand, and with free thiol groups of cysteine residues, on the other.

Kits are available commercially that permit conjugation of proteins to a variety of amine-reactive or thiol-reactive fluorophores: Molecular Probes, Inc. (Eugene, Oreg., USA), e.g., offers kits for conjugating proteins to Alexa Fluor 350, Alexa Fluor 430, Fluorescein-EX, Alexa Fluor 488, Oregon Green 488, Alexa Fluor 532, Alexa Fluor 546, Alexa Fluor 546, Alexa Fluor 568, Alexa Fluor 594, and Texas Red-X.

A wide variety of other amine-reactive and thiol-reactive fluorophores are available commercially (Molecular Probes, Inc., Eugene, Oreg., USA), including Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA).

The polypeptides of the present invention can also be conjugated to fluorophores, other proteins, and other macromolecules, using bifunctional linking reagents. Common homobifunctional reagents include, e.g., APG, AEDP, BASED, BMB, BMDB, BMH, BMOE, BM[PEO]3, BM[PEO]4, BS3, BSOCOES, DFDNB, DMA, DMP, DMS, DPDPB, DSG, DSP (Lomant's Reagent), DSS, DST, DTBP, DTME, DTSSP, EGS, HBVS, Sulfo-BSOCOES, Sulfo-DST, Sulfo-EGS (all available from Pierce, Rockford, Ill., USA); common heterobifunctional cross-linkers include ABH, AMAS, ANB-NOS, APDP, ASBA, BMPA, BMPH, BMPS, EDC, EMCA, EMCH, EMCS, KMUA, KMUH, GMBS, LC-SMCC, LC-SPDP, MBS, M2C2H, MPBH, MSA, NHS-ASA, PDPH, PMPI, SADP, SAED, SAND, SANPAH, SASD, SATP, SBAP, SFAD, SIA, SIAB, SMCC, SMPB, SMPH, SMPT, SPDP, Sulfo-EMCS, Sulfo-GMBS, Sulfo-HSAB, Sulfo-KMUS, Sulfo-LC-SPDP, Sulfo-MBS, Sulfo-NHS-LC-ASA, Sulfo-SADP, Sulfo-SANPAH, Sulfo-SIAB, Sulfo-SMCC, Sulfo-SMPB, Sulfo-LC-SMPT, SVSB, TFCS (all available Pierce, Rockford, Ill., USA).

Polypeptides of the present invention, including full length polypeptides, fragments and fusion proteins, can be conjugated, using such cross-linking reagents, to fluorophores that are not amine- or thiol-reactive. Other labels that usefully can be conjugated to polypeptides of the present invention include radioactive labels, echosonographic contrast reagents, and MRI contrast agents.

Polypeptides of the present invention, including full length polypeptides, fragments and fusion proteins, can also usefully be conjugated using cross-linking agents to carrier proteins, such as KLH, bovine thyroglobulin, and even bovine serum albumin (BSA), to increase immunogenicity for raising anti-OSP antibodies.

Polypeptides of the present invention, including full length polypeptides, fragments and fusion proteins, can also usefully be conjugated to polyethylene glycol (PEG); PEGylation increases the serum half life of proteins administered intravenously for replacement therapy. Delgado et al., *Crit. Rev. Ther. Drug Carrier Syst.* 9(3-4): 249-304 (1992); Scott et al., *Curr. Pharm. Des.* 4(6): 423-38 (1998); DeSantis et al., *Curr. Opin. Biotechnol.* 10(4): 324-30 (1999). PEG monomers can be attached to the protein directly or through a linker, with PEGylation using PEG monomers activated with tresyl chloride (2,2,2-trifluoroethanesulphonyl chloride) permitting direct attachment under mild conditions.

Polypeptides of the present invention are also inclusive of analogs of a polypeptide encoded by a nucleic acid molecule according to the instant invention. In a preferred embodiment, this polypeptide is an OSP. In a more preferred embodiment, this polypeptide is derived from a polypeptide having part or all of the amino acid sequence of SEQ ID NO: 129-295. Also preferred is an analog polypeptide comprising one or more substitutions of non-natural amino acids or non-native inter-residue bonds compared to the naturally occurring polypeptide. In one embodiment, the analog is structurally similar to an OSP, but one or more peptide linkages is replaced by a linkage selected from the group consisting of —CH$_2$NH—, —CH$_2$S—, —CH$_2$—CH$_2$—, —CH=CH—(cis and trans), —COCH$_2$—, —CH(OH)CH$_2$— and —CH$_2$SO—. In another embodiment, the analog comprises substitution of one or more amino acids of an OSP with a D-amino acid of the same type or other non-natural amino acid in order to generate more stable peptides. D-amino acids can readily be incorporated during chemical peptide synthesis: peptides assembled from D-amino acids are more resistant to proteolytic attack; incorporation of D-amino acids can also be used to confer specific three-dimensional conformations on the peptide. Other amino acid analogues commonly added during chemical synthesis include ornithine, norleucine, phosphorylated amino acids (typically phosphoserine, phosphothreonine, phosphotyrosine), L-malonyltyrosine, a non-hydrolyzable analog of phosphotyrosine (see, e.g., Kole et al., *Biochem.*

*Biophys. Res. Com.* 209: 817-821 (1995)), and various halogenated phenylalanine derivatives.

Non-natural amino acids can be incorporated during solid phase chemical synthesis or by recombinant techniques, although the former is typically more common. Solid phase chemical synthesis of peptides is well established in the art. Procedures are described, inter alia, in Chan et al. (eds.), *Fmoc Solid Phase Peptide Synthesis: A Practical Approach* (Practical Approach Series), Oxford Univ. Press (March 2000); Jones, *Amino Acid and Peptide Synthesis* (Oxford Chemistry Primers, No 7), Oxford Univ. Press (1992); and Bodanszky, *Principles of Peptide Synthesis* (Springer Laboratory), Springer Verlag (1993).

Amino acid analogues having detectable labels are also usefully incorporated during synthesis to provide derivatives and analogs. Biotin, for example can be added using biotinoyl-(9-fluorenylmethoxycarbonyl)-L-lysine (FMOC biocytin) (Molecular Probes, Eugene, Oreg., USA). Biotin can also be added enzymatically by incorporation into a fusion protein of an *E. coli* BirA substrate peptide. The FMOC and tBOC derivatives of dabcyl-L-lysine (Molecular Probes, Inc., Eugene, Oreg., USA) can be used to incorporate the dabcyl chromophore at selected sites in the peptide sequence during synthesis. The aminonaphthalene derivative EDANS, the most common fluorophore for pairing with the dabcyl quencher in fluorescence resonance energy transfer (FRET) systems, can be introduced during automated synthesis of peptides by using EDANS-FMOC-L-glutamic acid or the corresponding tBOC derivative (both from Molecular Probes, Inc., Eugene, Oreg., USA). Tetramethylrhodamine fluorophores can be incorporated during automated FMOC synthesis of peptides using (FMOC)-TMR-L-lysine (Molecular Probes, Inc. Eugene, Oreg., USA).

Other useful amino acid analogues that can be incorporated during chemical synthesis include aspartic acid, glutamic acid, lysine, and tyrosine analogues having allyl side-chain protection (Applied Biosystems, Inc., Foster City, Calif., USA); the allyl side chain permits synthesis of cyclic, branched-chain, sulfonated, glycosylated, and phosphorylated peptides.

A large number of other FMOC-protected non-natural amino acid analogues capable of incorporation during chemical synthesis are available commercially, including, e.g., Fmoc-2-aminobicyclo[2.2.1]heptane-2-carboxylic acid, Fmoc-3-endo-aminobicyclo[2.2.1]heptane-2-endo-carboxylic acid, Fmoc-3-exo-aminobicyclo[2.2.1]heptane-2-exo-carboxylic acid, Fmoc-3-endo-amino-bicyclo[2.2.1]hept-5-ene-2-endo-carboxylic acid, Fmoc-3-exo-amino-bicyclo[2.2.1]hept-5-ene-2-exo-carboxylic acid, Fmoc-cis-2-amino-1-cyclohexanecarboxylic acid, Fmoc-trans-2-amino-1-cyclohexanecarboxylic acid, Fmoc-1-amino-1-cyclopentanecarboxylic acid, Fmoc-cis-2-amino-1-cyclopentanecarboxylic acid, Fmoc-1-amino-1-cyclopropanecarboxylic acid, Fmoc-D-2-amino-4-(ethylthio)butyric acid, Fmoc-L-2-amino-4-(ethylthio) butyric acid, Fmoc-L-buthionine, Fmoc-5-methyl-L-Cysteine, Fmoc-2-aminobenzoic acid (anthranillic acid), Fmoc-3-aminobenzoic acid, Fmoc-4-aminobenzoic acid, Fmoc-2-aminobenzophenone-2'-carboxylic acid, Fmoc-N-(4-aminobenzoyl)-β-alanine, Fmoc-2-amino-4,5-dimethoxybenzoic acid, Fmoc-4-aminohippuric acid, Fmoc-2-amino-3-hydroxybenzoic acid, Fmoc-2-amino-5-hydroxybenzoic acid, Fmoc-3-amino-4-hydroxybenzoic acid, Fmoc-4-amino-3-hydroxybenzoic acid, Fmoc-5-amino-2-hydroxybenzoic acid, Fmoc-5-amino-2-hydroxybenzoic acid, Fmoc-2-amino-3-methoxybenzoic acid, Fmoc-4-amino-3-methoxybenzoic acid, Fmoc-2-amino-3-methylbenzoic acid, Fmoc-2-amino-5-methylbenzoic acid, Fmoc-2-amino-6-methylbenzoic acid, Fmoc-3-amino-2-methylbenzoic acid, Fmoc-3-amino-4-methylbenzoic acid, Fmoc-4-amino-3-methylbenzoic acid, Fmoc-3-amino-2-naphthoic acid, Fmoc-D,L-3-amino-3-phenylpropionic acid, Fmoc-L-Methyldopa, Fmoc-2-amino-4,6-dimethyl-3-pyridinecarboxylic acid, Fmoc-D,L-amino-2-thiophenacetic acid, Fmoc-4-(carboxymethyl)piperazine, Fmoc-4-carboxypiperazine, Fmoc-4-(carboxymethyl)homopiperazine, Fmoc-4-phenyl-4-piperidinecarboxylic acid, Fmoc-L-1,2,3, 4-tetrahydronorharman-3-carboxylic acid, Fmoc-L-thiazolidine-4-carboxylic acid, all available from The Peptide Laboratory (Richmond, Calif., USA).

Non-natural residues can also be added biosynthetically by engineering a suppressor tRNA, typically one that recognizes the UAG stop codon, by chemical aminoacylation with the desired unnatural amino acid. Conventional site-directed mutagenesis is used to introduce the chosen stop codon UAG at the site of interest in the protein gene. When the acylated suppressor tRNA and the mutant gene are combined in an in vitro transcription/translation system, the unnatural amino acid is incorporated in response to the UAG codon to give a protein containing that amino acid at the specified position. Liu et al., *Proc. Natl. Acad. Sci. USA* 96(9): 4780-5 (1999); Wang et al., *Science* 292(5516): 498-500 (2001).

Fusion Proteins

Another aspect of the present invention relates to the fusion of a polypeptide of the present invention to heterologous polypeptides. In a preferred embodiment, the polypeptide of the present invention is an OSP. In a more preferred embodiment, the polypeptide of the present invention that is fused to a heterologous polypeptide which comprises part or all of the amino acid sequence of SEQ ID NO: 129-295, or is a mutein, homologous polypeptide, analog or derivative thereof. In an even more preferred embodiment, the fusion protein is encoded by a nucleic acid molecule comprising all or part of the nucleic acid sequence of SEQ ID NO: 1-128, or comprises all or part of a nucleic acid sequence that selectively hybridizes or is homologous to a nucleic acid molecule comprising a nucleic acid sequence of SEQ ID NO: 1-128.

The fusion proteins of the present invention will include at least one fragment of a polypeptide of the present invention, which fragment is at least 6, typically at least 8, often at least 15, and usefully at least 16, 17, 18, 19, or 20 amino acids long. The fragment of the polypeptide of the present to be included in the fusion can usefully be at least 25 amino acids long, at least 50 amino acids long, and can be at least 75, 100, or even 150 amino acids long. Fusions that include the entirety of a polypeptide of the present invention have particular utility.

The heterologous polypeptide included within the fusion protein of the present invention is at least 6 amino acids in length, often at least 8 amino acids in length, and preferably at least 15, 20, or 25 amino acids in length. Fusions that include larger polypeptides, such as the IgG Fc region, and even entire proteins (such as GFP chromophore-containing proteins) are particularly useful.

As described above in the description of vectors and expression vectors of the present invention, which discussion is incorporated here by reference in its entirety, heterologous polypeptides to be included in the fusion proteins of the present invention can usefully include those designed to facilitate purification and/or visualization of recombinantly-expressed proteins. See, e.g., Ausubel, Chapter 16, (1992), supra. Although purification tags can also be incorporated into fusions that are chemically synthesized, chemical synthesis typically provides sufficient purity that further purification by HPLC suffices; however, visualization tags as above described retain their utility even when the protein is produced by chemical synthesis, and when so included render the fusion proteins of the present invention useful as directly detectable markers of the presence of a polypeptide of the invention.

As also discussed above, heterologous polypeptides to be included in the fusion proteins of the present invention can usefully include those that facilitate secretion of recombinantly expressed proteins into the periplasmic space or extracellular milieu for prokaryotic hosts or into the culture medium for eukaryotic cells through incorporation of secretion signals and/or leader sequences. For example, a $His^6$ tagged protein can be purified on a Ni affinity column and a GST fusion protein can be purified on a glutathione affinity column. Similarly, a fusion protein comprising the Fc domain of IgG can be purified on a Protein A or Protein G column and a fusion protein comprising an epitope tag such as myc can be purified using an immunoaffinity column containing an anti-c-myc antibody. It is preferable that the epitope tag be separated from the protein encoded by the essential gene by an enzymatic cleavage site that can be cleaved after purification. See also the discussion of nucleic acid molecules encoding fusion proteins that may be expressed on the surface of a cell.

Other useful fusion proteins of the present invention include those that permit use of the polypeptide of the present invention as bait in a yeast two-hybrid system. See Bartel et al. (eds.), *The Yeast Two-Hybrid System*, Oxford University Press (1997); Zhu et al., *Yeast Hybrid Technologies*, Eaton Publishing (2000); Fields et al., *Trends Genet.* 10(8): 286-92 (1994); Mendelsohn et al., *Curr. Opin. Biotechnol.* 5(5): 482-6 (1994); Luban et al., *Curr. Opin. Biotechnol.* 6(1): 59-64 (1995); Allen et al., *Trends Biochem. Sci.* 20(12): 511-6 (1995); Drees, *Curr. Opin. Chem. Biol.* 3(1): 64-70 (1999); Topcu et al., *Pharm. Res.* 17(9): 1049-55 (2000); Fashena et al., *Gene* 250(1-2): 1-14 (2000); Colas et al., *Nature* 380, 548-550 (1996); Norman, T. et al., *Science* 285, 591-595 (1999); Fabbrizio et al., *Oncogene* 18, 4357-4363 (1999); Xu et al., *Proc Natl Acad Sci USA*. 94, 12473-12478 (1997); Yang, et al., *Nuc. Acids Res.* 23, 1152-1156 (1995); Kolonin et al., *Proc Natl Acad Sci USA* 95, 14266-14271 (1998); Cohen et al., *Proc Natl Acad Sci USA* 95, 14272-14277 (1998); Uetz, et al. *Nature* 403, 623-627 (2000); Ito, et al., *Proc Natl Acad Sci USA* 98, 4569-4574 (2001). Typically, such fusion is to either *E. coli* LexA or yeast GAL4 DNA binding domains. Related bait plasmids are available that express the bait fused to a nuclear localization signal.

Other useful fusion proteins include those that permit display of the encoded polypeptide on the surface of a phage or cell, fusions to intrinsically fluorescent proteins, such as green fluorescent protein (GFP), and fusions to the IgG Fc region, as described above.

The polypeptides of the present invention can also usefully be fused to protein toxins, such as *Pseudomonas* exotoxin A, diphtheria toxin, shiga toxin A, anthrax toxin lethal factor, or ricin, in order to effect ablation of cells that bind or take up the proteins of the present invention.

Fusion partners include, inter alia, myc, hemagglutinin (HA), GST, immunoglobulins, β-galactosidase, biotin trpE, protein A, β-lactamase, α-amylase, maltose binding protein, alcohol dehydrogenase, polyhistidine (for example, six histidine at the amino and/or carboxyl terminus of the polypeptide), lacZ, green fluorescent protein (GFP), yeast a mating factor, GAL4 transcription activation or DNA binding domain, luciferase, and serum proteins such as ovalbumin, albumin and the constant domain of IgG. See, e.g., Ausubel (1992), supra and Ausubel (1999), supra. Fusion proteins may also contain sites for specific enzymatic cleavage, such as a site that is recognized by enzymes such as Factor XIII, trypsin, pepsin, or any other enzyme known in the art. Fusion proteins will typically be made by either recombinant nucleic acid methods, as described above, chemically synthesized using techniques well known in the art (e.g., a Merrifield synthesis), or produced by chemical cross-linking.

Another advantage of fusion proteins is that the epitope tag can be used to bind the fusion protein to a plate or column through an affinity linkage for screening binding proteins or other molecules that bind to the OSP.

As further described below, the polypeptides of the present invention can readily be used as specific immunogens to raise antibodies that specifically recognize polypeptides of the present invention including OSPs and their allelic variants and homologues. The antibodies, in turn, can be used, inter alia, specifically to assay for the polypeptides of the present invention, particularly OSPs, e.g. by ELISA for detection of protein fluid samples, such as serum, by immunohistochemistry or laser scanning cytometry, for detection of protein in tissue samples, or by flow cytometry, for detection of intracellular protein in cell suspensions, for specific antibody-mediated isolation and/or purification of OSPs, as for example by immunoprecipitation, and for use as specific agonists or antagonists of OSPs.

One may determine whether polypeptides of the present invention including OSPs, muteins, homologous proteins or allelic variants or fusion proteins of the present invention are functional by methods known in the art. For instance, residues that are tolerant of change while retaining function can be identified by altering the polypeptide at known residues using methods known in the art, such as alanine scanning mutagenesis, Cunningham et al., *Science* 244(4908): 1081-5 (1989); transposon linker scanning mutagenesis, Chen et al., *Gene* 263(1-2): 39-48 (2001); combinations of homolog- and alanine-scanning mutagenesis, Jin et al., *J. Mol. Biol.* 226(3): 851-65 (1992); and combinatorial alanine scanning, Weiss et al., *Proc. Natl. Acad. Sci. USA* 97(16): 8950-4 (2000), followed by functional assay. Transposon linker scanning kits are available commercially (New England Biolabs, Beverly, Mass., USA, catalog. no. E7-102S; EZ::TN™ In-Frame Linker Insertion Kit, catalogue no. EZI04KN, (Epicentre Technologies Corporation, Madison, Wis., USA).

Purification of the polypeptides or fusion proteins of the present invention is well known and within the skill of one having ordinary skill in the art. See, e.g., Scopes, *Protein Purification*, 2d ed. (1987). Purification of recombinantly expressed polypeptides is described above. Purification of chemically-synthesized peptides can readily be effected, e.g., by HPLC.

Accordingly, it is an aspect of the present invention to provide the isolated polypeptides or fusion proteins of the present invention in pure or substantially pure form in the presence or absence of a stabilizing agent. Stabilizing agents include both proteinaceous and non-proteinaceous material and are well known in the art. Stabilizing agents, such as albumin and polyethylene glycol (PEG) are known and are commercially available.

Although high levels of purity are preferred when the isolated polypeptide or fusion protein of the present invention are used as therapeutic agents, such as in vaccines and replacement therapy, the isolated polypeptides of the present invention are also useful at lower purity. For example, partially purified polypeptides of the present invention can be used as immunogens to raise antibodies in laboratory animals.

In a preferred embodiment, the purified and substantially purified polypeptides of the present invention are in compositions that lack detectable ampholytes, acrylamide monomers, bis-acrylamide monomers, and polyacrylamide.

The polypeptides or fusion proteins of the present invention can usefully be attached to a substrate. The substrate can be porous or solid, planar or non-planar; the bond can be covalent or noncovalent. For example, the peptides of the invention may be stabilized by covalent linkage to albumin. See, U.S. Pat. No. 5,876,969, the contents of which are hereby incorporated in its entirety.

The polypeptides or fusion proteins of the present invention can also be usefully bound to a porous substrate, commonly a membrane, typically comprising nitrocellulose, polyvinylidene fluoride (PVDF), or cationically derivatized, hydrophilic PVDF; so bound, the polypeptides or fusion proteins of the present invention can be used to detect and quantify antibodies, e.g. in serum, that bind specifically to the immobilized polypeptide or fusion protein of the present invention.

As another example, the polypeptides or fusion proteins of the present invention can usefully be bound to a substantially nonporous substrate, such as plastic, to detect and quantify antibodies, e.g. in serum, that bind specifically to the immobilized protein of the present invention. Such plastics include polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof; when the assay is performed in a standard microtiter dish, the plastic is typically polystyrene.

The polypeptides and fusion proteins of the present invention can also be attached to a substrate suitable for use as a surface enhanced laser desorption ionization source; so attached, the polypeptide or fusion protein of the present invention is useful for binding and then detecting secondary proteins that bind with sufficient affinity or avidity to the surface-bound polypeptide or fusion protein to indicate biologic interaction there between. The polypeptides or fusion proteins of the present invention can also be attached to a substrate suitable for use in surface plasmon resonance detection; so attached, the polypeptide or fusion protein of the present invention is useful for binding and then detecting secondary proteins that bind with sufficient affinity or avidity to the surface-bound polypeptide or fusion protein to indicate biological interaction there between.

Alternative Transcripts

In another aspect, the present invention provides splice variants of genes and proteins encoded thereby. The identification of a novel splice variant which encodes an amino acid sequence with a novel region can be targeted for the generation of reagents for use in detection and/or treatment of cancer. The novel amino acid sequence may lead to a unique protein structure, protein subcellular localization, biochemical processing or function of the splice variant. This information can be used to directly or indirectly facilitate the generation of additional or novel therapeutics or diagnostics. The nucleotide sequence in this novel splice variant can be used as a nucleic acid probe for the diagnosis and/or treatment of cancer.

Specifically, the newly identified sequences may enable the production of new antibodies or compounds directed against the novel region for use as a therapeutic or diagnostic. Alternatively, the newly identified sequences may alter the biochemical or biological properties of the encoded protein in such a way as to enable the generation of improved or different therapeutics targeting this protein.

Antibodies

In another aspect, the invention provides antibodies, including fragments and derivatives thereof, that bind specifically to polypeptides encoded by the nucleic acid molecules of the invention. In a preferred embodiment, the antibodies are specific for a polypeptide that is an OSP, or a fragment, mutein, derivative, analog or fusion protein thereof. In a more preferred embodiment, the antibodies are specific for a polypeptide that comprises SEQ ID NO: 129-295, or a fragment, mutein, derivative, analog or fusion protein thereof.

The antibodies of the present invention can be specific for linear epitopes, discontinuous epitopes, or conformational epitopes of such proteins or protein fragments, either as present on the protein in its native conformation or, in some cases, as present on the proteins as denatured, as, e.g., by solubilization in SDS. New epitopes may also be due to a difference in post translational modifications (PTMs) in disease versus normal tissue. For example, a particular site on an OSP may be glycosylated in cancerous cells, but not glycosylated in normal cells or vice versa. In addition, alternative splice forms of an OSP may be indicative of cancer. Differential degradation of the C or N-terminus of an OSP may also be a marker or target for anticancer therapy. For example, an OSP may be N-terminal degraded in cancer cells exposing new epitopes to antibodies which may selectively bind for diagnostic or therapeutic uses.

As is well known in the art, the degree to which an antibody can discriminate among molecular species in a mixture will depend, in part, upon the conformational relatedness of the species in the mixture; typically, the antibodies of the present invention will discriminate over adventitious binding to non-OSP polypeptides by at least two-fold, more typically by at least 5-fold, typically by more than 10-fold, 25-fold, 50-fold, 75-fold, and often by more than 100-fold, and on occasion by more than 500-fold or 1000-fold. When used to detect the proteins or protein fragments of the present invention, the antibody of the present invention is sufficiently specific when it can be used to determine the presence of the polypeptide of the present invention in samples derived from human ovarian.

Typically, the affinity or avidity of an antibody (or antibody multimer, as in the case of an IgM pentamer) of the present invention for a protein or protein fragment of the present invention will be at least about $1\times10^{-6}$ molar (M), typically at least about $5\times10^{-7}$ M, $1\times10^{-7}$ M, with affinities and avidities of at least $1\times10^{-8}$ M, $5\times10^{-9}$ M, $1\times10^{-10}$ M and up to $1\times10^{-13}$ M proving especially useful.

The antibodies of the present invention can be naturally occurring forms, such as IgG, IgM, IgD, IgE, IgY, and IgA, from any avian, reptilian, or mammalian species.

Human antibodies can, but will infrequently, be drawn directly from human donors or human cells. In such case, antibodies to the polypeptides of the present invention will typically have resulted from fortuitous immunization, such as autoimmune immunization, with the polypeptide of the present invention. Such antibodies will typically, but will not invariably, be polyclonal. In addition, individual polyclonal antibodies may be isolated and cloned to generate monoclonals.

Human antibodies are more frequently obtained using transgenic animals that express human immunoglobulin genes, which transgenic animals can be affirmatively immunized with the protein immunogen of the present invention. Human Ig-transgenic mice capable of producing human antibodies and methods of producing human antibodies therefrom upon specific immunization are described, inter alia, in U.S. Pat. Nos. 6,162,963; 6,150,584; 6,114,598; 6,075,181; 5,939,598; 5,877,397; 5,874,299; 5,814,318; 5,789,650; 5,770,429; 5,661,016; 5,633,425; 5,625,126; 5,569,825;

5,545,807; 5,545,806, and 5,591,669, the disclosures of which are incorporated herein by reference in their entireties. Such antibodies are typically monoclonal, and are typically produced using techniques developed for production of murine antibodies.

Human antibodies are particularly useful, and often preferred, when the antibodies of the present invention are to be administered to human beings as in vivo diagnostic or therapeutic agents, since recipient immune response to the administered antibody will often be substantially less than that occasioned by administration of an antibody derived from another species, such as mouse.

IgG, IgM, IgD, IgE, IgY, and IgA antibodies of the present invention are also usefully obtained from other species, including mammals such as rodents (typically mouse, but also rat, guinea pig, and hamster), lagomorphs (typically rabbits), and also larger mammals, such as sheep, goats, cows, and horses; or egg laying birds or reptiles such as chickens or alligators. In such cases, as with the transgenic human-antibody-producing non-human mammals, fortuitous immunization is not required, and the non-human mammal is typically affirmatively immunized, according to standard immunization protocols, with the polypeptide of the present invention. One form of avian antibodies may be generated using techniques described in WO 00/29444, published 25 May 2000, which is herein incorporated by reference in its entirety.

As discussed above, virtually all fragments of 8 or more contiguous amino acids of a polypeptide of the present invention can be used effectively as immunogens when conjugated to a carrier, typically a protein such as bovine thyroglobulin, keyhole limpet hemocyanin, or bovine serum albumin, conveniently using a bifunctional linker such as those described elsewhere above, which discussion is incorporated by reference here.

Immunogenicity can also be conferred by fusion of the polypeptide of the present invention to other moieties. For example, polypeptides of the present invention can be produced by solid phase synthesis on a branched polylysine core matrix; these multiple antigenic peptides (MAPs) provide high purity, increased avidity, accurate chemical definition and improved safety in vaccine development. Tam et al., *Proc. Natl. Acad. Sci. USA* 85: 5409-5413 (1988); Posnett et al., *J. Biol. Chem.* 263: 1719-1725 (1988).

Protocols for immunizing non-human mammals or avian species are well-established in the art. See Harlow et al. (eds.), *Using Antibodies: A Laboratory Manual*, Cold Spring Harbor Laboratory (1998); Coligan et al. (eds.), *Current Protocols in Immunology*, John Wiley & Sons, Inc. (2001); Zola, *Monoclonal Antibodies: Preparation and Use of Monoclonal Antibodies and Engineered Antibody Derivatives (Basics: From Background to Bench)*, Springer Verlag (2000); Gross M, Speck *J. Dtsch. Tierarztl. Wochenschr.* 103: 417-422 (1996). Immunization protocols often include multiple immunizations, either with or without adjuvants such as Freund's complete adjuvant and Freund's incomplete adjuvant, and may include naked DNA immunization. Moss, *Semin. Immunol.* 2: 317-327 (1990).

Antibodies from non-human mammals and avian species can be polyclonal or monoclonal, with polyclonal antibodies having certain advantages in immunohistochemical detection of the polypeptides of the present invention and monoclonal antibodies having advantages in identifying and distinguishing particular epitopes of the polypeptides of the present invention. Antibodies from avian species may have particular advantage in detection of the polypeptides of the present invention, in human serum or tissues. Vikinge et al., *Biosens. Bioelectron.* 13: 1257-1262 (1998). Following immunization, the antibodies of the present invention can be obtained using any art-accepted technique. Such techniques are well known in the art and are described in detail in references such as Coligan, supra; Zola, supra; Howard et al. (eds.), *Basic Methods in Antibody Production and Characterization*, CRC Press (2000); Harlow, supra; Davis (ed.), *Monoclonal Antibody Protocols*, Vol. 45, Humana Press (1995); Delves (ed.), *Antibody Production Essential Techniques*, John Wiley & Son Ltd (1997); and Kenney, *Antibody Solution An Antibody Methods Manual*, Chapman & Hall (1997).

Briefly, such techniques include, inter alia, production of monoclonal antibodies by hybridomas and expression of antibodies or fragments or derivatives thereof from host cells engineered to express immunoglobulin genes or fragments thereof. These two methods of production are not mutually exclusive: genes encoding antibodies specific for the polypeptides of the present invention can be cloned from hybridomas and thereafter expressed in other host cells. Nor need the two necessarily be performed together: e.g., genes encoding antibodies specific for the polypeptides of the present invention can be cloned directly from B cells known to be specific for the desired protein, as further described in U.S. Pat. No. 5,627,052, the disclosure of which is incorporated herein by reference in its entirety, or from antibody-displaying phage.

Recombinant expression in host cells is particularly useful when fragments or derivatives of the antibodies of the present invention are desired.

Host cells for recombinant antibody production of whole antibodies, antibody fragments, or antibody derivatives can be prokaryotic or eukaryotic.

Prokaryotic hosts are particularly useful for producing phage displayed antibodies of the present invention.

The technology of phage-displayed antibodies, in which antibody variable region fragments are fused, for example, to the gene III protein (pIII) or gene VIII protein (pVIII) for display on the surface of filamentous phage, such as M13, is by now well-established. See, e.g., Sidhu, *Curr. Opin. Biotechnol.* 11(6): 610-6 (2000); Griffiths et al., *Curr. Opin. Biotechnol.* 9(1): 102-8 (1998); Hoogenboom et al., *Immunotechnology*, 4(1): 1-20 (1998); Rader et al., *Current Opinion in Biotechnology* 8: 503-508 (1997); Aujame et al., *Human Antibodies* 8: 155-168 (1997); Hoogenboom, *Trends in Biotechnol.* 15: 62-70 (1997); de Kruif et al., 17: 453-455 (1996); Barbas et al., *Trends in Biotechnol.* 14: 230-234 (1996); Winter et al., *Ann. Rev. Immunol.* 433-455 (1994). Techniques and protocols required to generate, propagate, screen (pan), and use the antibody fragments from such libraries have recently been compiled. See, e.g., Barbas (2001), supra; Kay, supra; and Abelson, supra.

Typically, phage-displayed antibody fragments are scFv fragments or Fab fragments; when desired, full length antibodies can be produced by cloning the variable regions from the displaying phage into a complete antibody and expressing the full length antibody in a further prokaryotic or a eukaryotic host cell. Eukaryotic cells are also useful for expression of the antibodies, antibody fragments, and antibody derivatives of the present invention. For example, antibody fragments of the present invention can be produced in *Pichia pastoris* and in *Saccharomyces cerevisiae*. See, e.g., Takahashi et al., *Biosci. Biotechnol. Biochem.* 64(10): 2138-44 (2000); Freyre et al., J. Biotechnol. 76(2-3):1 57-63 (2000); Fischer et al., *Biotechnol. Appl. Biochem.* 30 (Pt 2): 117-20 (1999); Pennell et al., *Res. Immunol.* 149(6): 599-603 (1998); Eldin et al., *J. Immunol. Methods.* 201(1): 67-75 (1997); Frenken et al., *Res. Immunol.* 149(6): 589-99 (1998); and Shusta et al., *Nature Biotechnol.* 16(8): 773-7 (1998).

Antibodies, including antibody fragments and derivatives, of the present invention can also be produced in insect cells. See, e.g., Li et al., *Protein Expr. Purif.* 21(1): 121-8 (2001); Ailor et al., *Biotechnol. Bioeng.* 58(2-3): 196-203 (1998); Hsu et al., *Biotechnol. Prog.* 13(1): 96-104 (1997); Edelman et al., *Immunology* 91(1): 13-9 (1997); and Nesbit et al., *J. Immunol. Methods* 151(1-2): 201-8 (1992).

Antibodies and fragments and derivatives thereof of the present invention can also be produced in plant cells, particularly maize or tobacco, Giddings et al., *Nature Biotechnol.* 18(11): 1151-5 (2000); Gavilondo et al., *Biotechniques* 29(1): 128-38 (2000); Fischer et al., *J. Biol. Regul. Homeost. Agents* 14(2): 83-92 (2000); Fischer et al., *Biotechnol. Appl. Biochem.* 30 (Pt 2): 113-6 (1999); Fischer et al., *Biol. Chem.* 380(7-8): 825-39 (1999); Russell, *Curr. Top. Microbiol. Immunol.* 240: 119-38 (1999); and Ma et al., *Plant Physiol.* 109(2): 341-6 (1995).

Antibodies, including antibody fragments and derivatives, of the present invention can also be produced in transgenic, non-human, mammalian milk. See, e.g. Pollock et al., *J. Immunol Methods.* 231: 147-57 (1999); Young et al., *Res. Immunol.* 149: 609-10 (1998); and Limonta et al., *Immunotechnology* 1: 107-13 (1995).

Mammalian cells useful for recombinant expression of antibodies, antibody fragments, and antibody derivatives of the present invention include CHO cells, COS cells, 293 cells, and myeloma cells. Verma et al., *J. Immunol. Methods* 216 (1-2):165-81 (1998) review and compare bacterial, yeast, insect and mammalian expression systems for expression of antibodies. Antibodies of the present invention can also be prepared by cell free translation, as further described in Merk et al., *J. Biochem.* (Tokyo) 125(2): 328-33 (1999) and Ryabova et al., *Nature Biotechnol.* 15(1): 79-84 (1997), and in the milk of transgenic animals, as further described in Pollock et al., *J. Immunol. Methods* 231(1-2): 147-57 (1999).

The invention further provides antibody fragments that bind specifically to one or more of the polypeptides of the present invention or to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention. Among such useful fragments are Fab, Fab', Fv, F(ab)'$_2$, and single-chain Fv (scFv) fragments. Other useful fragments are described in Hudson, *Curr. Opin. Biotechnol.* 9(4): 395-402 (1998).

The present invention also relates to antibody derivatives that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention.

Among such useful derivatives are chimeric, primatized, and humanized antibodies; such derivatives are less immunogenic in human beings, and thus are more suitable for in vivo administration, than are unmodified antibodies from non-human mammalian species. Another useful method is PEGylation to increase the serum half life of the antibodies.

Chimeric antibodies typically include heavy and/or light chain variable regions (including both CDR and framework residues) of immunoglobulins of one species, typically mouse, fused to constant regions of another species, typically human. See, e.g., Morrison et al., *Proc. Natl. Acad. Sci. USA.* 81(21): 6851-5 (1984); Sharon et al., *Nature* 309(5966): 364-7 (1984); Takeda et al., *Nature* 314(6010): 452-4 (1985); and U.S. Pat. No. 5,807,715 the disclosure of which is incorporated herein by reference in its entirety. Primatized and humanized antibodies typically include heavy and/or light chain CDRs from a murine antibody grafted into a non-human primate or human antibody V region framework, usually further comprising a human constant region, Riechmann et al., *Nature* 332(6162): 323-7 (1988); Co et al., *Nature* 351(6326): 501-2 (1991); and U.S. Pat. Nos. 6,054,297; 5,821,337; 5,770,196; 5,766,886; 5,821,123; 5,869,619; 6,180,377; 6,013,256; 5,693,761; and 6,180,370, the disclosures of which are incorporated herein by reference in their entireties. Other useful antibody derivatives of the invention include heteromeric antibody complexes and antibody fusions, such as diabodies (bispecific antibodies), single-chain diabodies, and intrabodies.

It is contemplated that the nucleic acids encoding the antibodies of the present invention can be operably joined to other nucleic acids forming a recombinant vector for cloning or for expression of the antibodies of the invention. Accordingly, the present invention includes any recombinant vector containing the coding sequences, or part thereof, whether for eukaryotic transduction, transfection or gene therapy. Such vectors may be prepared using conventional molecular biology techniques, known to those with skill in the art, and would comprise DNA encoding sequences for the immunoglobulin V-regions including framework and CDRs or parts thereof, and a suitable promoter either with or without a signal sequence for intracellular transport. Such vectors may be transduced or transfected into eukaryotic cells or used for gene therapy (Marasco et al., *Proc. Natl. Acad. Sci.* (*USA*) 90: 7889-7893 (1993); Duan et al., *Proc. Natl. Acad. Sci.* (*USA*) 91: 5075-5079 (1994), by conventional techniques, known to those with skill in the art.

The antibodies of the present invention, including fragments and derivatives thereof, can usefully be labeled. It is, therefore, another aspect of the present invention to provide labeled antibodies that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention. The choice of label depends, in part, upon the desired use.

For example, when the antibodies of the present invention are used for immunohistochemical staining of tissue samples, the label can usefully be an enzyme that catalyzes production and local deposition of a detectable product. Enzymes typically conjugated to antibodies to permit their immunohistochemical visualization are well known, and include alkaline phosphatase, β-galactosidase, glucose oxidase, horseradish peroxidase (HRP), and urease. Typical substrates for production and deposition of visually detectable products include o-nitrophenyl-beta-D-galactopyranoside (ONPG); o-phenylenediamine dihydrochloride (OPD); p-nitrophenyl phosphate (PNPP); p-nitrophenyl-beta-D-galactopryanoside (PNPG); 3',3'-diaminobenzidine (DAB); 3-amino-9-ethylcarbazole (AEC); 4-chloro-1-naphthol (CN); 5-bromo-4-chloro-3-indolyl-phosphate (BCIP); ABTS®; BluoGal; iodonitrotetrazolium (INT); nitroblue tetrazolium chloride (NBT); phenazine methosulfate (PMS); phenolphthalein monophosphate (PMP); tetramethyl benzidine (TMB); tetranitroblue tetrazolium (TNBT); X-Gal; X-Gluc; and X-Glucoside.

Other substrates can be used to produce products for local deposition that are luminescent. For example, in the presence of hydrogen peroxide ($H_2O_2$), horseradish peroxidase (HRP) can catalyze the oxidation of cyclic diacylhydrazides, such as luminol. Immediately following the oxidation, the luminol is in an excited state (intermediate reaction product), which decays to the ground state by emitting light. Strong enhancement of the light emission is produced by enhancers, such as phenolic compounds. Advantages include high sensitivity, high resolution, and rapid detection without radioactivity and requiring only small amounts of antibody. See, e.g., Thorpe et al., *Methods Enzymol.* 133: 331-53 (1986); Kricka et al., *J. Immunoassay* 17(1): 67-83 (1996); and Lundqvist et al., *J. Biolumin. Chemilumin.* 10(6): 353-9 (1995). Kits for such enhanced chemiluminescent detection (ECL) are available commercially. The antibodies can also be labeled using colloidal gold.

As another example, when the antibodies of the present invention are used, e.g., for flow cytometric detection, for scanning laser cytometric detection, or for fluorescent immunoassay, they can usefully be labeled with fluorophores. There are a wide variety of fluorophore labels that can usefully be attached to the antibodies of the present invention. For flow cytometric applications, both for extracellular detection and for intracellular detection, common useful fluorophores can be fluorescein isothiocyanate (FITC), allophycocyanin (APC), R-phycoerythrin (PE), peridinin chlorophyll protein (PerCP), Texas Red, Cy3, Cy5, fluorescence resonance energy tandem fluorophores such as PerCP-Cy5.5, PE-Cy5, PE-Cy5.5, PE-Cy7, PE-Texas Red, and APC-Cy7.

Other fluorophores include, inter alia, Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA), and Cy2, Cy3, Cy3.5, Cy5, Cy5.5, Cy7, all of which are also useful for fluorescently labeling the antibodies of the present invention. For secondary detection using labeled avidin, streptavidin, captavidin or neutravidin, the antibodies of the present invention can usefully be labeled with biotin.

When the antibodies of the present invention are used, e.g., for western blotting applications, they can usefully be labeled with radioisotopes, such as $^{33}P$, $^{32}P$, $^{35}S$, $^{3}H$, and $^{125}I$. As another example, when the antibodies of the present invention are used for radioimmunotherapy, the label can usefully be $^{228}Th$, $^{227}Ac$, $^{225}Ac$, $^{223}Ra$, $^{213}Bi$, $^{212}Pb$, $^{212}Bi$, $^{211}At$, $^{203}Pb$, $^{194}Os$, $^{188}Re$, $^{186}Re$, $^{153}Sm$, $^{149}Tb$, $^{131}I$, $^{125}I$, $^{111}In$, $^{105}Tc$, $^{99m}Tc$, $^{97}Ru$, $^{90}Y$, $^{90}Sr$, $^{88}Y$, $^{72}Se$, $^{67}Cu$, or $^{47}Sc$.

As another example, when the antibodies of the present invention are to be used for in vivo diagnostic use, they can be rendered detectable by conjugation to MRI contrast agents, such as gadolinium diethylenetriaminepentaacetic acid (DTPA), Lauffer et al., *Radiology* 207(2): 529-38 (1998), or by radioisotopic labeling.

As would be understood, use of the labels described above is not restricted to the application as for which they were mentioned.

The antibodies of the present invention, including fragments and derivatives thereof, can also be conjugated to toxins, in order to target the toxin's ablative action to cells that display and/or express the polypeptides of the present invention. Commonly, the antibody in such immunotoxins is conjugated to *Pseudomonas* exotoxin A, diphtheria toxin, shiga toxin A, anthrax toxin lethal factor, or ricin. See Hall (ed.), *Immunotoxin Methods and Protocols* (Methods in Molecular Biology, vol. 166), Humana Press (2000); and Frankel et al. (eds.), *Clinical Applications of Immunotoxins*, Springer-Verlag (1998).

The antibodies of the present invention can usefully be attached to a substrate, and it is, therefore, another aspect of the invention to provide antibodies that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention, attached to a substrate. Substrates can be porous or nonporous, planar or nonplanar. For example, the antibodies of the present invention can usefully be conjugated to filtration media, such as NHS-activated Sepharose or CNBr-activated Sepharose for purposes of immunoaffinity chromatography. For example, the antibodies of the present invention can usefully be attached to paramagnetic microspheres, typically by biotin-streptavidin interaction, which microsphere can then be used for isolation of cells that express or display the polypeptides of the present invention. As another example, the antibodies of the present invention can usefully be attached to the surface of a microtiter plate for ELISA.

As noted above, the antibodies of the present invention can be produced in prokaryotic and eukaryotic cells. It is, therefore, another aspect of the present invention to provide cells that express the antibodies of the present invention, including hybridoma cells, B cells, plasma cells, and host cells recombinantly modified to express the antibodies of the present invention.

In yet a further aspect, the present invention provides aptamers evolved to bind specifically to one or more of the OSPs of the present invention or to polypeptides encoded by the OSNAs of the invention.

In sum, one of skill in the art, provided with the teachings of this invention, has available a variety of methods which may be used to alter the biological properties of the antibodies of this invention including methods which would increase or decrease the stability or half-life, immunogenicity, toxicity, affinity or yield of a given antibody molecule, or to alter it in any other way that may render it more suitable for a particular application.

Transgenic Animals and Cells

In another aspect, the invention provides transgenic cells and non-human organisms comprising nucleic acid molecules of the invention. In a preferred embodiment, the transgenic cells and non-human organisms comprise a nucleic acid molecule encoding an OSP. In a preferred embodiment, the OSP comprises an amino acid sequence selected from SEQ ID NO: 129-295, or a fragment, mutein, homologous protein or allelic variant thereof. In another preferred embodiment, the transgenic cells and non-human organism comprise an OSNA of the invention, preferably an OSNA comprising a nucleotide sequence selected from the group consisting of SEQ ID NO: 1-128, or a part, substantially similar nucleic acid molecule, allelic variant or hybridizing nucleic acid molecule thereof.

In another embodiment, the transgenic cells and non-human organisms have a targeted disruption or replacement of the endogenous orthologue of the human OSG. The transgenic cells can be embryonic stem cells or somatic cells. The transgenic non-human organisms can be chimeric, nonchimeric heterozygotes, and nonchimeric homozygotes. Methods of producing transgenic animals are well known in the art. See, e.g., Hogan et al., *Manipulating the Mouse Embryo: A Laboratory Manual*, 2d ed., Cold Spring Harbor Press (1999); Jackson et al., *Mouse Genetics and Transgenics: A Practical Approach*, Oxford University Press (2000); and Pinkert, *Transgenic Animal Technology: A Laboratory Handbook*, Academic Press (1999).

Any technique known in the art may be used to introduce a nucleic acid molecule of the invention into an animal to produce the founder lines of transgenic animals. Such techniques include, but are not limited to, pronuclear microinjection. (see, e.g., Paterson et al., *Appl. Microbiol. Biotechnol.* 40: 691-698 (1994); Carver et al., *Biotechnology* 11: 1263-1270 (1993); Wright et al., *Biotechnology* 9: 830-834 (1991); and U.S. Pat. No. 4,873,191, herein incorporated by reference in its entirety); retrovirus-mediated gene transfer into germ lines, blastocysts or embryos (see, e.g., Van der Putten et al., *Proc. Natl. Acad. Sci., USA* 82: 6148-6152 (1985)); gene targeting in embryonic stem cells (see, e.g., Thompson et al., *Cell* 56: 313-321 (1989)); electroporation of cells or embryos (see, e.g., Lo, 1983, *Mol. Cell. Biol.* 3: 1803-1814 (1983)); introduction using a gene gun (see, e.g., Ulmer et al., *Science* 259: 1745-49 (1993); introducing nucleic acid constructs into embryonic pleuripotent stem cells and transferring the stem cells back into the blastocyst; and sperm-mediated gene transfer (see, e.g., Lavitrano et al., *Cell* 57: 717-723 (1989)).

Other techniques include, for example, nuclear transfer into enucleated oocytes of nuclei from cultured embryonic, fetal, or adult cells induced to quiescence (see, e.g., Campell et al., *Nature* 380: 64-66 (1996); Wilmut et al., *Nature* 385: 810-813 (1997)). The present invention provides for transgenic animals that carry the transgene (i.e., a nucleic acid molecule of the invention) in all their cells, as well as animals which carry the transgene in some, but not all their cells, i.e. e., mosaic animals or chimeric animals.

The transgene may be integrated as a single transgene or as multiple copies, such as in concatamers, e.g., head-to-head tandems or head-to-tail tandems. The transgene may also be selectively introduced into and activated in a particular cell type by following, e.g., the teaching of Lasko et al. et al., *Proc. Natl. Acad. Sci. USA* 89: 6232-6236 (1992). The regulatory sequences required for such a cell-type specific activation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (RT-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Methods for creating a transgenic animal with a disruption of a targeted gene are also well known in the art. In general, a vector is designed to comprise some nucleotide sequences homologous to the endogenous targeted gene. The vector is introduced into a cell so that it may integrate, via homologous recombination with chromosomal sequences, into the endogenous gene, thereby disrupting the function of the endogenous gene. The transgene may also be selectively introduced into a particular cell type, thus inactivating the endogenous gene in only that cell type. See, e.g., Gu et al., *Science* 265: 103-106 (1994). The regulatory sequences required for such a cell-type specific inactivation will depend upon the particular cell type of interest, and will be apparent to those of skill in the art. See, e.g., Smithies et al., *Nature* 317: 230-234 (1985); Thomas et al., *Cell* 51: 503-512 (1987); Thompson et al., *Cell* 5: 313-321 (1989).

In one embodiment, a mutant, non-functional nucleic acid molecule of the invention (or a completely unrelated DNA sequence) flanked by DNA homologous to the endogenous nucleic acid sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene. See, e.g., Thomas, supra and Thompson, supra. However this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from an animal or patient or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc.

The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft. See, e.g., U.S. Pat. Nos. 5,399,349 and 5,460,959, each of which is incorporated by reference herein in its entirety.

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Computer Readable Means

A further aspect of the invention is a computer readable means for storing the nucleic acid and amino acid sequences of the instant invention. In a preferred embodiment, the invention provides a computer readable means for storing SEQ ID NO: 129-295 and SEQ ID NO: 1-128 as described herein, as the complete set of sequences or in any combination. The records of the computer readable means can be accessed for reading and display and for interface with a computer system for the application of programs allowing for the location of data upon a query for data meeting certain criteria, the comparison of sequences, the alignment or ordering of sequences meeting a set of criteria, and the like.

The nucleic acid and amino acid sequences of the invention are particularly useful as components in databases useful for search analyses as well as in sequence analysis algorithms. As used herein, the terms "nucleic acid sequences of the invention" and "amino acid sequences of the invention" mean any detectable chemical or physical characteristic of a polynucleotide or polypeptide of the invention that is or may be reduced to or stored in a computer readable form. These include, without limitation, chromatographic scan data or peak data, photographic data or scan data therefrom, and mass spectrographic data.

This invention provides computer readable media having stored thereon sequences of the invention. A computer readable medium may comprise one or more of the following: a nucleic acid sequence comprising a sequence of a nucleic acid sequence of the invention; an amino acid sequence comprising an amino acid sequence of the invention; a set of nucleic acid sequences wherein at least one of said sequences comprises the sequence of a nucleic acid sequence of the invention; a set of amino acid sequences wherein at least one of said sequences comprises the sequence of an amino acid sequence of the invention; a data set representing a nucleic acid sequence comprising the sequence of one or more nucleic acid sequences of the invention; a data set representing a nucleic acid sequence encoding an amino acid sequence comprising the sequence of an amino acid sequence of the invention; a set of nucleic acid sequences wherein at least one of said sequences comprises the sequence of a nucleic acid sequence of the invention; a set of amino acid sequences wherein at least one of said sequences comprises the sequence of an amino acid sequence of the invention; a data set representing a nucleic acid sequence comprising the sequence of a nucleic acid sequence of the invention; a data set representing a nucleic acid sequence encoding an amino acid sequence comprising the sequence of an amino acid sequence of the invention. The computer readable medium can be any composition of matter used to store information or data, including, for example, commercially available floppy disks, tapes, hard drives, compact disks, and video disks.

Also provided by the invention are methods for the analysis of character sequences, particularly genetic sequences. Preferred methods of sequence analysis include, for example, methods of sequence homology analysis, such as identity and similarity analysis, RNA structure analysis, sequence assembly, cladistic analysis, sequence motif analysis, open reading frame determination, nucleic acid base calling, and sequencing chromatogram peak analysis.

A computer-based method is provided for performing nucleic acid sequence identity or similarity identification. This method comprises the steps of providing a nucleic acid sequence comprising the sequence of a nucleic acid of the invention in a computer readable medium; and comparing said nucleic acid sequence to at least one nucleic acid or amino acid sequence to identify sequence identity or similarity.

A computer-based method is also provided for performing amino acid homology identification, said method comprising the steps of: providing an amino acid sequence comprising the sequence of an amino acid of the invention in a computer readable medium; and comparing said amino acid sequence to at least one nucleic acid or an amino acid sequence to identify homology.

A computer-based method is still further provided for assembly of overlapping nucleic acid sequences into a single nucleic acid sequence, said method comprising the steps of: providing a first nucleic acid sequence comprising the sequence of a nucleic acid of the invention in a computer readable medium; and screening for at least one overlapping region between said first nucleic acid sequence and a second nucleic acid sequence. In addition, the invention includes a method of using patterns of expression associated with either the nucleic acids or proteins in a computer-based method to diagnose disease.

Diagnostic Methods for Ovarian Cancer

The present invention also relates to quantitative and qualitative diagnostic assays and methods for detecting, diagnosing, monitoring, staging and predicting cancers by comparing expression of an OSNA or an OSP in a human patient that has or may have ovarian cancer, or who is at risk of developing ovarian cancer, with the expression of an OSNA or an OSP in a normal human control. For purposes of the present invention, "expression of an OSNA" or "OSNA expression" means the quantity of OSNA mRNA that can be measured by any method known in the art or the level of transcription that can be measured by any method known in the art in a cell, tissue, organ or whole patient. Similarly, the term "expression of an OSP" or "OSP expression" means the amount of OSP that can be measured by any method known in the art or the level of translation of an OSNA that can be measured by any method known in the art.

The present invention provides methods for diagnosing ovarian cancer in a patient, by analyzing for changes in levels of OSNA or OSP in cells, tissues, organs or bodily fluids compared with levels of OSNA or OSP in cells, tissues, organs or bodily fluids of preferably the same type from a normal human control, wherein an increase, or decrease in certain cases, in levels of an OSNA or OSP in the patient versus the normal human control is associated with the presence of ovarian cancer or with a predilection to the disease. In another preferred embodiment, the present invention provides methods for diagnosing ovarian cancer in a patient by analyzing changes in the structure of the mRNA of an OSG compared to the mRNA from a normal control. These changes include, without limitation, aberrant splicing, alterations in polyadenylation and/or alterations in 5' nucleotide capping. In yet another preferred embodiment, the present invention provides methods for diagnosing ovarian cancer in a patient by analyzing changes in an OSP compared to an OSP from a normal patient. These changes include, e.g., alterations, including post translational modifications such as glycosylation and/or phosphorylation of the OSP or changes in the subcellular OSP localization.

For purposes of the present invention, diagnosing means that OSNA or OSP levels are used to determine the presence or absence of disease in a patient. As will be understood by those of skill in the art, measurement of other diagnostic parameters may be required for definitive diagnosis or determination of the appropriate treatment for the disease. The determination may be made by a clinician, a doctor, a testing laboratory, or a patient using an over the counter test. The patient may have symptoms of disease or may be asymptomatic. In addition, the OSNA or OSP levels of the present invention may be used as screening marker to determine whether further tests or biopsies are warranted. In addition, the OSNA or OSP levels may be used to determine the vulnerability or susceptibility to disease.

In a preferred embodiment, the expression of an OSNA is measured by determining the amount of a mRNA that encodes an amino acid sequence selected from SEQ ID NO: 129-295, a homolog, an allelic variant, or a fragment thereof. In a more preferred embodiment, the OSNA expression that is measured is the level of expression of an OSNA mRNA selected from SEQ ID NO: 1-128, or a hybridizing nucleic acid, homologous nucleic acid or allelic variant thereof, or a part of any of these nucleic acid molecules. OSNA expression may be measured by any method known in the art, such as those described supra, including measuring mRNA expression by Northern blot, quantitative or qualitative reverse transcriptase PCR (RT-PCR), microarray, dot or slot blots or in situ hybridization. See, e.g., Ausubel (1992), supra; Ausubel (1999), supra; Sambrook (1989), supra; and Sambrook (2001), supra. OSNA transcription may be measured by any method known in the art including using a reporter gene hooked up to the promoter of an OSG of interest or doing nuclear run-off assays. Alterations in mRNA structure, e.g., aberrant splicing variants, may be determined by any method known in the art, including, RT-PCR followed by sequencing or restriction analysis. As necessary, OSNA expression may be compared to a known control, such as normal ovarian nucleic acid, to detect a change in expression.

In another preferred embodiment, the expression of an OSP is measured by determining the level of an OSP having an amino acid sequence selected from the group consisting of SEQ ID NO: 129-295, a homolog, an allelic variant, or a fragment thereof. Such levels are preferably determined in at least one of cells, tissues, organs and/or bodily fluids, including determination of normal and abnormal levels. Thus, for instance, a diagnostic assay in accordance with the invention for diagnosing over- or underexpression of an OSNA or OSP compared to normal control bodily fluids, cells, or tissue samples may be used to diagnose the presence of ovarian cancer. The expression level of an OSP may be determined by any method known in the art, such as those described supra. In a preferred embodiment, the OSP expression level may be determined by radioimmunoassays, competitive-binding assays, ELISA, Western blot, FACS, immunohistochemistry, immunoprecipitation, proteomic approaches: two-dimensional gel electrophoresis (2D electrophoresis) and non-gel-based approaches such as mass spectrometry or protein interaction profiling. See, e.g, Harlow (1999), supra; Ausubel (1992), supra; and Ausubel (1999), supra. Alterations in the OSP structure may be determined by any method known in the art, including, e.g., using antibodies that specifically recognize phosphoserine, phosphothreonine or phosphotyrosine residues, two-dimensional polyacrylamide gel electrophoresis (2D PAGE) and/or chemical analysis of amino acid residues of the protein. Id.

In a preferred embodiment, a radioimmunoassay (RIA) or an ELISA is used. An antibody specific to an OSP is prepared if one is not already available. In a preferred embodiment, the antibody is a monoclonal antibody. The anti-OSP antibody is bound to a solid support and any free protein binding sites on the solid support are blocked with a protein such as bovine serum albumin. A sample of interest is incubated with the antibody on the solid support under conditions in which the OSP will bind to the anti-OSP antibody. The sample is removed, the solid support is washed to remove unbound material, and an anti-OSP antibody that is linked to a detectable reagent (a radioactive substance for RIA and an enzyme for ELISA) is added to the solid support and incubated under conditions in which binding of the OSP to the labeled antibody will occur. After binding, the unbound labeled antibody is removed by washing. For an ELISA, one or more substrates are added to produce a colored reaction product that is based upon the amount of an OSP in the sample. For an RIA, the solid support is counted for radioactive decay signals by any method known in the art. Quantitative results for both RIA and ELISA typically are obtained by reference to a standard curve.

Other methods to measure OSP levels are known in the art. For instance, a competition assay may be employed wherein an anti-OSP antibody is attached to a solid support and an allocated amount of a labeled OSP and a sample of interest are incubated with the solid support. The amount of labeled OSP attached to the solid support can be correlated to the quantity of an OSP in the sample.

Of the proteomic approaches, 2D PAGE is a well known technique. Isolation of individual proteins from a sample such as serum is accomplished using sequential separation of proteins by isoelectric point and molecular weight. Typically, polypeptides are first separated by isoelectric point (the first dimension) and then separated by size using an electric current (the second dimension). In general, the second dimension is perpendicular to the first dimension. Because no two proteins with different sequences are identical on the basis of both size and charge, the result of 2D PAGE is a roughly square gel in which each protein occupies a unique spot.

Analysis of the spots with chemical or antibody probes, or subsequent protein microsequencing can reveal the relative abundance of a given protein and the identity of the proteins in the sample.

Expression levels of an OSNA can be determined by any method known in the art, including PCR and other nucleic acid methods, such as ligase chain reaction (LCR) and nucleic acid sequence based amplification (NASBA), can be used to detect malignant cells for diagnosis and monitoring of various malignancies. For example, reverse-transcriptase PCR (RT-PCR) is a powerful technique which can be used to detect the presence of a specific mRNA population in a complex mixture of thousands of other mRNA species. In RT-PCR, an mRNA species is first reverse transcribed to complementary DNA (cDNA) with use of the enzyme reverse transcriptase; the cDNA is then amplified as in a standard PCR reaction.

Hybridization to specific DNA molecules (e.g., oligonucleotides) arrayed on a solid support can be used to both detect the expression of and quantitate the level of expression of one or more OSNAs of interest. In this approach, all or a portion of one or more OSNAs is fixed to a substrate. A sample of interest, which may comprise RNA, e.g., total RNA or polyA-selected mRNA, or a complementary DNA (cDNA) copy of the RNA is incubated with the solid support under conditions in which hybridization will occur between the DNA on the solid support and the nucleic acid molecules in the sample of interest. Hybridization between the substrate-bound DNA and the nucleic acid molecules in the sample can be detected and quantitated by several means, including, without limitation, radioactive labeling or fluorescent labeling of the nucleic acid molecule or a secondary molecule designed to detect the hybrid.

The above tests can be carried out on samples derived from a variety of cells, bodily fluids and/or tissue extracts such as homogenates or solubilized tissue obtained from a patient. Tissue extracts are obtained routinely from tissue biopsy and autopsy material. Bodily fluids useful in the present invention include blood, urine, saliva or any other bodily secretion or derivative thereof. As used herein "blood" includes whole blood, plasma, serum, circulating epithelial cells, constituents, or any derivative of blood.

In addition to detection in bodily fluids, the proteins and nucleic acids of the invention are suitable to detection by cell capture technology. Whole cells may be captured by a variety methods for example magnetic separation, such as described in U.S. Pat. Nos. 5,200,084; 5,186,827; 5,108,933; and 4,925,788, the disclosures of which are incorporated herein by reference in their entireties. Epithelial cells may be captured using such products as Dynabeads® or CELLection™ (Dynal Biotech, Oslo, Norway). Alternatively, fractions of blood may be captured, e.g., the buffy coat fraction (50 mm cells isolated from 5 ml of blood) containing epithelial cells. In addition, cancer cells may be captured using the techniques described in WO 00/47998, the disclosure of which is incorporated herein by reference in its entirety. Once the cells are captured or concentrated, the proteins or nucleic acids are detected by the means described in the subject application. Alternatively, nucleic acids may be captured directly from blood samples, see U.S. Pat. Nos. 6,156,504, 5,501,963; or WO 01/42504, the disclosures of which are incorporated herein by reference in their entireties.

In a preferred embodiment, the specimen tested for expression of OSNA or OSP includes without limitation ovarian tissue, ovarian cells grown in cell culture, blood, serum, lymph node tissue, and lymphatic fluid. In another preferred embodiment, especially when metastasis of a primary ovarian cancer is known or suspected, specimens include, without limitation, tissues from brain, bone, bone marrow, liver, lungs, colon, and adrenal glands. In general, the tissues may be sampled by biopsy, including, without limitation, needle biopsy, e.g., transthoracic needle aspiration, cervical mediatinoscopy, endoscopic lymph node biopsy, video-assisted thoracoscopy, exploratory thoracotomy, bone marrow biopsy and bone marrow aspiration.

All the methods of the present invention may optionally include determining the expression levels of one or more other cancer markers in addition to determining the expression level of an OSNA or OSP. In many cases, the use of another cancer marker will decrease the likelihood of false positives or false negatives. In one embodiment, the one or more other cancer markers include other OSNAs or OSPs as disclosed herein. Other cancer markers useful in the present invention will depend on the cancer being tested and are known to those of skill in the art. In a preferred embodiment, at least one other cancer marker in addition to a particular OSNA or OSP is measured. In a more preferred embodiment, at least two other additional cancer markers are used. In an even more preferred embodiment, at least three, more preferably at least five, even more preferably at least ten additional cancer markers are used.

Diagnosing

In one aspect, the invention provides a method for determining the expression levels and/or structural alterations of one or more OSNA and/or OSP in a sample from a patient suspected of having ovarian cancer. In general, the method comprises the steps of obtaining the sample from the patient, determining the expression level or structural alterations of an OSNA and/or OSP and then ascertaining whether the patient has ovarian cancer from the expression level of the OSNA or OSP. In general, if high expression relative to a control of an OSNA or OSP is indicative of ovarian cancer, a diagnostic assay is considered positive if the level of expression of the OSNA or OSP is at least one and a half times higher, and more preferably are at least two times higher, still more preferably five times higher, even more preferably at least ten times higher, than in preferably the same cells, tissues or bodily fluid of a normal human control. In contrast, if low expression relative to a control of an OSNA or OSP is indicative of ovarian cancer, a diagnostic assay is considered positive if the level of expression of the OSNA or OSP is at least one and a half times lower, and more preferably are at least two times lower, still more preferably five times lower, even more preferably at least ten times lower than in preferably the same cells, tissues or bodily fluid of a normal human control. The normal human control may be from a different patient or from uninvolved tissue of the same patient.

The present invention also provides a method of determining whether ovarian cancer has metastasized in a patient. One may identify whether the ovarian cancer has metastasized by measuring the expression levels and/or structural alterations of one or more OSNAs and/or OSPs in a variety of tissues. The presence of an OSNA or OSP in a tissue other than ovarian at levels higher than that of corresponding noncancerous tissue (e.g., the same tissue from another individual) is indicative of metastasis if high level expression of an OSNA or OSP is associated with ovarian cancer. Similarly, the presence of an OSNA or OSP in a tissue other than ovarian at levels lower than that of corresponding noncancerous tissue is indicative of metastasis if low level expression of an OSNA or OSP is associated with ovarian cancer. Further, the presence of a structurally altered OSNA or OSP that is associated with ovarian cancer is also indicative of metastasis.

In general, if high expression relative to a control of an OSNA or OSP is indicative of metastasis, an assay for metastasis is considered positive if the level of expression of the OSNA or OSP is at least one and a half times higher, and more preferably are at least two times higher, still more preferably five times higher, even more preferably at least ten times higher, than in preferably the same cells, tissues or bodily fluid of a normal human control. In contrast, if low expression relative to a control of an OSNA or OSP is indicative of metastasis, an assay for metastasis is considered positive if the level of expression of the OSNA or OSP is at least one and a half times lower, and more preferably are at least two times lower, still more preferably five times lower, even more preferably at least ten times lower than in preferably the same cells, tissues or bodily fluid of a normal human control.

Staging

The invention also provides a method of staging ovarian cancer in a human patient. The method comprises identifying a human patient having ovarian cancer and analyzing cells, tissues or bodily fluids from such human patient for expression levels and/or structural alterations of one or more OSNAs or OSPs. First, one or more tumors from a variety of patients are staged according to procedures well known in the art, and the expression levels of one or more OSNAs or OSPs is determined for each stage to obtain a standard expression level for each OSNA and OSP. Then, the OSNA or OSP expression levels of the OSNA or OSP are determined in a biological sample from a patient whose stage of cancer is not known. The OSNA or OSP expression levels from the patient are then compared to the standard expression level. By comparing the expression level of the OSNAs and OSPs from the patient to the standard expression levels, one may determine the stage of the tumor. The same procedure may be followed using structural alterations of an OSNA or OSP to determine the stage of a ovarian cancer.

Monitoring

Further provided is a method of monitoring ovarian cancer in a human patient. One may monitor a human patient to determine whether there has been metastasis and, if there has been, when metastasis began to occur. One may also monitor a human patient to determine whether a preneoplastic lesion has become cancerous. One may also monitor a human patient to determine whether a therapy, e.g., chemotherapy, radiotherapy or surgery, has decreased or eliminated the ovarian cancer. The monitoring may determine if there has been a reoccurrence and, if so, determine its nature. The method comprises identifying a human patient that one wants to monitor for ovarian cancer, periodically analyzing cells, tissues or bodily fluids from such human patient for expression levels of one or more OSNAs or OSPs, and comparing the OSNA or OSP levels over time to those OSNA or OSP expression levels obtained previously. Patients may also be monitored by measuring one or more structural alterations in an OSNA or OSP that are associated with ovarian cancer.

If increased expression of an OSNA or OSP is associated with metastasis, treatment failure, or conversion of a preneoplastic lesion to a cancerous lesion, then detecting an increase in the expression level of an OSNA or OSP indicates that the tumor is metastasizing, that treatment has failed or that the lesion is cancerous, respectively. One having ordinary skill in the art would recognize that if this were the case, then a decreased expression level would be indicative of no metastasis, effective therapy or failure to progress to a neoplastic lesion. If decreased expression of an OSNA or OSP is associated with metastasis, treatment failure, or conversion of a preneoplastic lesion to a cancerous lesion, then detecting a decrease in the expression level of an OSNA or OSP indicates that the tumor is metastasizing, that treatment has failed or that the lesion is cancerous, respectively. In a preferred embodiment, the levels of OSNAs or OSPs are determined from the same cell type, tissue or bodily fluid as prior patient samples. Monitoring a patient for onset of ovarian cancer metastasis is periodic and preferably is done on a quarterly basis, but may be done more or less frequently.

The methods described herein can further be utilized as prognostic assays to identify subjects having or at risk of developing a disease or disorder associated with increased or decreased expression levels of an OSNA and/or OSP. The present invention provides a method in which a test sample is obtained from a human patient and one or more OSNAs and/or OSPs are detected. The presence of higher (or lower) OSNA or OSP levels as compared to normal human controls is diagnostic for the human patient being at risk for developing cancer, particularly ovarian cancer. The effectiveness of therapeutic agents to decrease (or increase) expression or activity of one or more OSNAs and/or OSPs of the invention can also be monitored by analyzing levels of expression of the OSNAs and/or OSPs in a human patient in clinical trials or in in vitro screening assays such as in human cells. In this way, the gene expression pattern can serve as a marker, indicative of the physiological response of the human patient or cells, as the case may be, to the agent being tested.

Detection of Genetic Lesions or Mutations

The methods of the present invention can also be used to detect genetic lesions or mutations in an OSG, thereby determining if a human with the genetic lesion is susceptible to developing ovarian cancer or to determine what genetic lesions are responsible, or are partly responsible, for a person's existing ovarian cancer. Genetic lesions can be detected, for example, by ascertaining the existence of a deletion, insertion and/or substitution of one or more nucleotides from the OSGs of this invention, a chromosomal rearrangement of an OSG, an aberrant modification of an OSG (such as of the methylation pattern of the genomic DNA), or allelic loss of an OSG. Methods to detect such lesions in the OSG of this invention are known to those having ordinary skill in the art following the teachings of the specification.

Methods of Detecting Noncancerous Ovarian Diseases

The present invention also provides methods for determining the expression levels and/or structural alterations of one or more OSNAs and/or OSPs in a sample from a patient suspected of having or known to have a noncancerous ovarian disease. In general, the method comprises the steps of obtaining a sample from the patient, determining the expression level or structural alterations of an OSNA and/or OSP, comparing the expression level or structural alteration of the OSNA or OSP to a normal ovarian control, and then ascertaining whether the patient has a noncancerous ovarian disease. In general, if high expression relative to a control of an OSNA or OSP is indicative of a particular noncancerous ovarian disease, a diagnostic assay is considered positive if the level of expression of the OSNA or OSP is at least two times higher, and more preferably are at least five times higher, even more preferably at least ten times higher, than in preferably the same cells, tissues or bodily fluid of a normal human control. In contrast, if low expression relative to a control of an OSNA or OSP is indicative of a noncancerous ovarian disease, a diagnostic assay is considered positive if the level of expression of the OSNA or OSP is at least two times lower, more preferably are at least five times lower, even more preferably at least ten times lower than in preferably the same cells, tissues or bodily fluid of a normal human control. The normal human control may be from a different patient or from uninvolved tissue of the same patient.

One having ordinary skill in the art may determine whether an OSNA and/or OSP is associated with a particular noncancerous ovarian disease by obtaining ovarian tissue from a patient having a noncancerous ovarian disease of interest and determining which OSNAs and/or OSPs are expressed in the tissue at either a higher or a lower level than in normal ovarian tissue. In another embodiment, one may determine whether an OSNA or OSP exhibits structural alterations in a particular noncancerous ovarian disease state by obtaining ovarian tissue from a patient having a noncancerous ovarian disease of interest and determining the structural alterations in one or more OSNAs and/or OSPs relative to normal ovarian tissue.

Methods for Identifying Ovarian Tissue

In another aspect, the invention provides methods for identifying ovarian tissue. These methods are particularly useful in, e.g., forensic science, ovarian cell differentiation and development, and in tissue engineering.

In one embodiment, the invention provides a method for determining whether a sample is ovarian tissue or has ovarian tissue-like characteristics. The method comprises the steps of providing a sample suspected of comprising ovarian tissue or having ovarian tissue-like characteristics, determining whether the sample expresses one or more OSNAs and/or OSPs, and, if the sample expresses one or more OSNAs and/or OSPs, concluding that the sample comprises ovarian tissue. In a preferred embodiment, the OSNA encodes a polypeptide having an amino acid sequence selected from SEQ ID NO: 129-295, or a homolog, allelic variant or fragment thereof. In a more preferred embodiment, the OSNA has a nucleotide sequence selected from SEQ ID NO: 1-128, or a hybridizing nucleic acid, an allelic variant or a part thereof. Determining whether a sample expresses an OSNA can be accomplished by any method known in the art. Preferred methods include hybridization to microarrays, Northern blot hybridization, and quantitative or qualitative RT-PCR. In another preferred embodiment, the method can be practiced by determining whether an OSP is expressed. Determining whether a sample expresses an OSP can be accomplished by any method known in the art. Preferred methods include Western blot, ELISA, RIA and 2D PAGE. In one embodiment, the OSP has an amino acid sequence selected from SEQ ID NO: 129-295, or a homolog, allelic variant or fragment thereof. In another preferred embodiment, the expression of at least two OSNAs and/or OSPs is determined. In a more preferred embodiment, the expression of at least three, more preferably four and even more preferably five OSNAs and/or OSPs are determined.

In one embodiment, the method can be used to determine whether an unknown tissue is ovarian tissue. This is particularly useful in forensic science, in which small, damaged pieces of tissues that are not identifiable by microscopic or other means are recovered from a crime or accident scene. In another embodiment, the method can be used to determine whether a tissue is differentiating or developing into ovarian tissue. This is important in monitoring the effects of the addition of various agents to cell or tissue culture, e.g., in producing new ovarian tissue by tissue engineering. These agents include, e.g., growth and differentiation factors, extracellular matrix proteins and culture medium. Other factors that may be measured for effects on tissue development and differentiation include gene transfer into the cells or tissues, alterations in pH, aqueous:air interface and various other culture conditions.

Methods for Producing and Modifying Ovarian Tissue

In another aspect, the invention provides methods for producing engineered ovarian tissue or cells. In one embodiment, the method comprises the steps of providing cells, introducing an OSNA or an OSG into the cells, and growing the cells under conditions in which they exhibit one or more properties of ovarian tissue cells. In a preferred embodiment, the cells are pleuripotent. As is well known in the art, normal ovarian tissue comprises a large number of different cell types. Thus, in one embodiment, the engineered ovarian tissue or cells comprises one of these cell types. In another embodiment, the engineered ovarian tissue or cells comprises more than one ovarian cell type. Further, the culture conditions of the cells or tissue may require manipulation in order to achieve full differentiation and development of the ovarian cell tissue. Methods for manipulating culture conditions are well known in the art.

Nucleic acid molecules encoding one or more OSPs are introduced into cells, preferably pleuripotent cells. In a preferred embodiment, the nucleic acid molecules encode OSPs having amino acid sequences selected from SEQ ID NO: 129-295, or homologous proteins, analogs, allelic variants or fragments thereof. In a more preferred embodiment, the nucleic acid molecules have a nucleotide sequence selected from SEQ ID NO: 1-128, or hybridizing nucleic acids, allelic variants or parts thereof. In another highly preferred embodiment, an OSG is introduced into the cells. Expression vectors and methods of introducing nucleic acid molecules into cells are well known in the art and are described in detail, supra.

Artificial ovarian tissue may be used to treat patients who have lost some or all of their ovarian function.

Pharmaceutical Compositions

In another aspect, the invention provides pharmaceutical compositions comprising the nucleic acid molecules, polypeptides, fusion proteins, antibodies, antibody derivatives, antibody fragments, agonists, antagonists, or inhibitors of the present invention. In a preferred embodiment, the pharmaceutical composition comprises an OSNA or part thereof. In a more preferred embodiment, the OSNA has a nucleotide sequence selected from the group consisting of SEQ ID NO: 1-128, a nucleic acid that hybridizes thereto, an allelic variant thereof, or a nucleic acid that has substantial sequence identity thereto. In another preferred embodiment, the pharmaceutical composition comprises an OSP or fragment thereof. In a more preferred embodiment, the pharmaceutical composition comprises an OSP having an amino acid sequence that is selected from the group consisting of SEQ ID NO: 129-295, a polypeptide that is homologous thereto, a fusion protein comprising all or a portion of the polypeptide, or an analog or derivative thereof. In another preferred embodiment, the pharmaceutical composition comprises an anti-OSP antibody, preferably an antibody that specifically binds to an OSP having an amino acid that is selected from the group consisting of SEQ ID NO: 129-295, or an antibody that binds to a polypeptide that is homologous thereto, a fusion protein comprising all or a portion of the polypeptide, or an analog or derivative thereof.

Due to the association of angiogenesis with cancer vascularization there is great need of new markers and methods for diagnosing angiogenesis activity to identify developing tumors and angiogenesis related diseases. Furthermore, great need is also present for new molecular targets useful in the treatment of angiogenesis and angiogenesis related diseases such as cancer. In addition known modulators of angiogenesis such as endostatin or vascular endothelial growth factor (VEGF). Use of the methods and compositions disclosed herein in combination with anti-angiogenesis drugs, drugs that block the matrix breakdown (such as BMS-275291, Dalteparin (Fragmin®), Suramin), drugs that inhibit endothelial cells (2-methoxyestradiol (2-ME), CC-5013 (Thalidomide Analog), Combretastatin A4 Phosphate, LY317615 (Protein Kinase C Beta Inhibitor), Soy Isoflavone (Genistein; Soy Protein Isolate), Thalidomide), drugs that block activators of angiogenesis (AE-941 (Neovastat™; GW786034), Anti-VEGF Antibody (Bevacizumab; Avastin™), Interferon-alpha, PTK787/ZK 222584, VEGF-Trap, ZD6474), Drugs that inhibit endothelial-specific integrin/survival signaling (EMD 121974, Anti-Anb3 Integrin Antibody (Medi-522; Vitaxin™)).

Such a composition typically contains from about 0.1 to 90% by weight of a therapeutic agent of the invention formulated in and/or with a pharmaceutically acceptable carrier or excipient.

Pharmaceutical formulation is a well-established art that is further described in Gennaro (ed.), *Remington: The Science and Practice of Pharmacy*, 20$^{th}$ ed., Lippincott, Williams & Wilkins (2000); Ansel et al., *Pharmaceutical Dosage Forms and Drug Delivery Systems*, 7$^{th}$ ed., Lippincott Williams & Wilkins (1999); and Kibbe (ed.), *Handbook of Pharmaceutical Excipients* American Pharmaceutical Association, 3$^{rd}$ ed. (2000) and thus need not be described in detail herein.

Briefly, formulation of the pharmaceutical compositions of the present invention will depend upon the route chosen for administration. The pharmaceutical compositions utilized in this invention can be administered by various routes including both enteral and parenteral routes, including oral, intravenous, intramuscular, subcutaneous, inhalation, topical, sublingual, rectal, intra-arterial, intramedullary, intrathecal, intraventricular, transmucosal, transdermal, intranasal, intraperitoneal, intrapulmonary, and intrauterine.

Oral dosage forms can be formulated as tablets, pills, dragees, capsules, liquids, gels, syrups, slurries, suspensions, and the like, for ingestion by the patient.

Solid formulations of the compositions for oral administration can contain suitable carriers or excipients, such as carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, sodium carboxymethylcellulose, or microcrystalline cellulose; gums including arabic and tragacanth; proteins such as gelatin and collagen; inorganics, such as kaolin, calcium carbonate, dicalcium phosphate, sodium chloride; and other agents such as acacia and alginic acid.

Agents that facilitate disintegration and/or solubilization can be added, such as the cross-linked polyvinyl pyrrolidone, agar, alginic acid, or a salt thereof, such as sodium alginate, microcrystalline cellulose, cornstarch, sodium starch glycolate, and alginic acid.

Tablet binders that can be used include acacia, methylcellulose, sodium carboxymethylcellulose, polyvinylpyrrolidone (Povidone™), hydroxypropyl methylcellulose, sucrose, starch and ethylcellulose.

Lubricants that can be used include magnesium stearates, stearic acid, silicone fluid, talc, waxes, oils, and colloidal silica.

Fillers, agents that facilitate disintegration and/or solubilization, tablet binders and lubricants, including the aforementioned, can be used singly or in combination.

Solid oral dosage forms need not be uniform throughout. For example, dragee cores can be used in conjunction with suitable coatings, such as concentrated sugar solutions, which can also contain gum arabic, talc, polyvinylpyrrolidone, carbopol gel, polyethylene glycol, and/or titanium dioxide, lacquer solutions, and suitable organic solvents or solvent mixtures.

Oral dosage forms of the present invention include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds can be dissolved or suspended in suitable liquids, such as fatty oils, liquid, or liquid polyethylene glycol with or without stabilizers.

Additionally, dyestuffs or pigments can be added to the tablets or dragee coatings for product identification or to characterize the quantity of active compound, i.e., dosage.

Liquid formulations of the pharmaceutical compositions for oral (enteral) administration are prepared in water or other aqueous vehicles and can contain various suspending agents such as methylcellulose, alginates, tragacanth, pectin, kelgin, carrageenan, acacia, polyvinylpyrrolidone, and polyvinyl alcohol. The liquid formulations can also include solutions, emulsions, syrups and elixirs containing, together with the active compound(s), wetting agents, sweeteners, and coloring and flavoring agents.

The pharmaceutical compositions of the present invention can also be formulated for parenteral administration. Formulations for parenteral administration can be in the form of aqueous or non-aqueous isotonic sterile injection solutions or suspensions.

For intravenous injection, water soluble versions of the compounds of the present invention are formulated in, or if provided as a lyophilate, mixed with, a physiologically acceptable fluid vehicle, such as 5% dextrose ("D5"), physiologically buffered saline, 0.9% saline, Hanks' solution, or Ringer's solution. Intravenous formulations may include carriers, excipients or stabilizers including, without limitation, calcium, human serum albumin, citrate, acetate, calcium chloride, carbonate, and other salts.

Intramuscular preparations, e.g. a sterile formulation of a suitable soluble salt form of the compounds of the present invention, can be dissolved and administered in a pharmaceutical excipient such as Water-for-Injection, 0.9% saline, or 5% glucose solution. Alternatively, a suitable insoluble form of the compound can be prepared and administered as a suspension in an aqueous base or a pharmaceutically acceptable oil base, such as an ester of a long chain fatty acid (e.g., ethyl oleate), fatty oils such as sesame oil, triglycerides, or liposomes.

Parenteral formulations of the compositions can contain various carriers such as vegetable oils, dimethylacetamide, dimethylformamide, ethyl lactate, ethyl carbonate, isopropyl myristate, ethanol, polyols (glycerol, propylene glycol, liquid polyethylene glycol, and the like).

Aqueous injection suspensions can also contain substances that increase the viscosity of the suspension, such as sodium carboxymethyl cellulose, sorbitol, or dextran. Non-lipid polycationic amino polymers can also be used for delivery. Optionally, the suspension can also contain suitable stabilizers or agents that increase the solubility of the compounds to allow for the preparation of highly concentrated solutions.

Pharmaceutical compositions of the present invention can also be formulated to permit injectable, long-term, deposition. Injectable depot forms may be made by forming microencapsulated matrices of the compound in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are also prepared by entrapping the drug in microemulsions that are compatible with body tissues.

The pharmaceutical compositions of the present invention can be administered topically. For topical use the compounds of the present invention can also be prepared in suitable forms to be applied to the skin, or mucus membranes of the nose and throat, and can take the form of lotions, creams, ointments, liquid sprays or inhalants, drops, tinctures, lozenges, or throat paints. Such topical formulations further can include chemical compounds such as dimethylsulfoxide (DMSO) to facilitate surface penetration of the active ingredient. In other transdermal formulations, typically in patch-delivered formulations, the pharmaceutically active compound is formulated with one or more skin penetrants, such as 2-N-methyl-pyrrolidone (NMP) or Azone. A topical semi-solid ointment formulation typically contains a concentration of the active ingredient from about 1 to 20%, e.g., 5 to 10%, in a carrier such as a pharmaceutical cream base.

For application to the eyes or ears, the compounds of the present invention can be presented in liquid or semi-liquid form formulated in hydrophobic or hydrophilic bases as ointments, creams, lotions, paints or powders.

For rectal administration the compounds of the present invention can be administered in the form of suppositories admixed with conventional carriers such as cocoa butter, wax or other glyceride.

Inhalation formulations can also readily be formulated. For inhalation, various powder and liquid formulations can be prepared. For aerosol preparations, a sterile formulation of the compound or salt form of the compound may be used in inhalers, such as metered dose inhalers, and nebulizers. Aerosolized forms may be especially useful for treating respiratory disorders.

Alternatively, the compounds of the present invention can be in powder form for reconstitution in the appropriate pharmaceutically acceptable carrier at the time of delivery.

The pharmaceutically active compound in the pharmaceutical compositions of the present invention can be provided as the salt of a variety of acids, including but not limited to hydrochloric, sulfuric, acetic, lactic, tartaric, malic, and succinic acid. Salts tend to be more soluble in aqueous or other protonic solvents than are the corresponding free base forms.

After pharmaceutical compositions have been prepared, they are packaged in an appropriate container and labeled for treatment of an indicated condition.

The active compound will be present in an amount effective to achieve the intended purpose. The determination of an effective dose is well within the capability of those skilled in the art.

A "therapeutically effective dose" refers to that amount of active ingredient, for example OSP polypeptide, fusion protein, or fragments thereof, antibodies specific for OSP, agonists, antagonists or inhibitors of OSP, which ameliorates the signs or symptoms of the disease or prevent progression thereof; as would be understood in the medical arts, cure, although desired, is not required.

The therapeutically effective dose of the pharmaceutical agents of the present invention can be estimated initially by in vitro tests, such as cell culture assays, followed by assay in model animals, usually mice, rats, rabbits, dogs, or pigs. The animal model can also be used to determine an initial preferred concentration range and route of administration.

For example, the ED50 (the dose therapeutically effective in 50% of the population) and LD50 (the dose lethal to 50% of the population) can be determined in one or more cell culture of animal model systems. The dose ratio of toxic to therapeutic effects is the therapeutic index, which can be expressed as LD50/ED50. Pharmaceutical compositions that exhibit large therapeutic indices are preferred.

The data obtained from cell culture assays and animal studies are used in formulating an initial dosage range for human use, and preferably provide a range of circulating concentrations that includes the ED50 with little or no toxicity. After administration, or between successive administrations, the circulating concentration of active agent varies within this range depending upon pharmacokinetic factors well known in the art, such as the dosage form employed, sensitivity of the patient, and the route of administration.

The exact dosage will be determined by the practitioner, in light of factors specific to the subject requiring treatment. Factors that can be taken into account by the practitioner include the severity of the disease state, general health of the subject, age, weight, gender of the subject, diet, time and frequency of administration, drug combination(s), reaction sensitivities, and tolerance/response to therapy. Long-acting pharmaceutical compositions can be administered every 3 to 4 days, every week, or once every two weeks depending on half-life and clearance rate of the particular formulation.

Normal dosage amounts may vary from 0.1 to 100,000 micrograms, up to a total dose of about 1 g, depending upon the route of administration. Where the therapeutic agent is a protein or antibody of the present invention, the therapeutic protein or antibody agent typically is administered at a daily dosage of 0.01 mg to 30 mg/kg of body weight of the patient (e.g., 1 mg/kg to 5 mg/kg). The pharmaceutical formulation can be administered in multiple doses per day, if desired, to achieve the total desired daily dose.

Guidance as to particular dosages and methods of delivery is provided in the literature and generally available to practitioners in the art. Those skilled in the art will employ different formulations for nucleotides than for proteins or their inhibitors. Similarly, delivery of polynucleotides or polypeptides will be specific to particular cells, conditions, locations, etc.

Conventional methods, known to those of ordinary skill in the art of medicine, can be used to administer the pharmaceutical formulation(s) of the present invention to the patient. The pharmaceutical compositions of the present invention can be administered alone, or in combination with other therapeutic agents or interventions.

Therapeutic Methods

The present invention further provides methods of treating subjects having defects in a gene of the invention, e.g., in expression, activity, distribution, localization, and/or solubility, which can manifest as a disorder of ovarian function. As used herein, "treating" includes all medically-acceptable types of therapeutic intervention, including palliation and prophylaxis (prevention) of disease. The term "treating" encompasses any improvement of a disease, including minor improvements. These methods are discussed below.

Gene Therapy and Vaccines

The isolated nucleic acids of the present invention can also be used to drive in vivo expression of the polypeptides of the present invention. In vivo expression can be driven from a vector, typically a viral vector, often a vector based upon a replication incompetent retrovirus, an adenovirus, or an adeno-associated virus (AAV), for the purpose of gene therapy. In vivo expression can also be driven from signals endogenous to the nucleic acid or from a vector, often a plasmid vector, such as pVAX1 (Invitrogen, Carlsbad, Calif., USA), for purpose of "naked" nucleic acid vaccination, as further described in U.S. Pat. Nos. 5,589,466; 5,679,647; 5,804,566; 5,830,877; 5,843,913; 5,880,104; 5,958,891; 5,985,847; 6,017,897; 6,110,898; 6,204,250, the disclosures of which are incorporated herein by reference in their entireties. For cancer therapy, it is preferred that the vector also be tumor-selective. See, e.g., Doronin et al., *J. Virol.* 75: 3314-24 (2001).

In another embodiment of the therapeutic methods of the present invention, a therapeutically effective amount of a pharmaceutical composition comprising a nucleic acid molecule of the present invention is administered. The nucleic acid molecule can be delivered in a vector that drives expression of an OSP, fusion protein, or fragment thereof, or without such vector. Nucleic acid compositions that can drive expression of an OSP are administered, for example, to complement a deficiency in the native OSP, or as DNA vaccines. Expression vectors derived from virus, replication deficient retroviruses, adenovirus, adeno-associated (AAV) virus, herpes virus, or vaccinia virus can be used as can plasmids. See, e.g., Cid-Arregui, supra. In a preferred embodiment, the nucleic acid molecule encodes an OSP having the amino acid sequence of SEQ ID NO: 129-295, or a fragment, fusion protein, allelic variant or homolog thereof.

In still other therapeutic methods of the present invention, pharmaceutical compositions comprising host cells that express an OSP, fusions, or fragments thereof can be administered. In such cases, the cells are typically autologous, so as to circumvent xenogeneic or allotypic rejection, and are administered to complement defects in OSP production or activity. In a preferred embodiment, the nucleic acid molecules in the cells encode an OSP having the amino acid sequence of SEQ ID NO: 129-295, or a fragment, fusion protein, allelic variant or homolog thereof.

Antisense Administration

Antisense nucleic acid compositions, or vectors that drive expression of an OSG antisense nucleic acid, are administered to downregulate transcription and/or translation of an OSG in circumstances in which excessive production, or production of aberrant protein, is the pathophysiologic basis of disease.

Antisense compositions useful in therapy can have a sequence that is complementary to coding or to noncoding regions of an OSG. For example, oligonucleotides derived from the transcription initiation site, e.g., between positions −10 and +10 from the start site, are preferred.

Catalytic antisense compositions, such as ribozymes, that are capable of sequence-specific hybridization to OSG transcripts, are also useful in therapy. See, e.g., Phylactou, *Adv. Drug Deliv. Rev.* 44(2-3): 97-108 (2000); Phylactou et al., *Hum. Mol. Genet.* 7(10): 1649-53 (1998); Rossi, *Ciba Found. Symp.* 209: 195-204 (1997); and Sigurdsson et al., *Trends Biotechnol.* 13(8): 286-9 (1995).

Other nucleic acids useful in the therapeutic methods of the present invention are those that are capable of triplex helix formation in or near the OSG genomic locus. Such triplexing oligonucleotides are able to inhibit transcription. See, e.g., Intody et al., *Nucleic Acids Res.* 28(21): 4283-90 (2000); and McGuffie et al., *Cancer Res.* 60(14): 3790-9 (2000). Pharmaceutical compositions comprising such triplex forming oligos (TFOS) are administered in circumstances in which excessive production, or production of aberrant protein, is a pathophysiologic basis of disease.

In a preferred embodiment, the antisense molecule is derived from a nucleic acid molecule encoding an OSP, preferably an OSP comprising an amino acid sequence of SEQ ID NO: 129-295, or a fragment, allelic variant or homolog thereof. In a more preferred embodiment, the antisense molecule is derived from a nucleic acid molecule having a nucleotide sequence of SEQ ID NO: 1-128, or a part, allelic variant, substantially similar or hybridizing nucleic acid thereof.

Polypeptide Administration

In one embodiment of the therapeutic methods of the present invention, a therapeutically effective amount of a pharmaceutical composition comprising an OSP, a fusion protein, fragment, analog or derivative thereof is administered to a subject with a clinically-significant OSP defect.

Protein compositions are administered, for example, to complement a deficiency in native OSP. In other embodiments, protein compositions are administered as a vaccine to elicit a humoral and/or cellular immune response to OSP. The immune response can be used to modulate activity of OSP or, depending on the immunogen, to immunize against aberrant or aberrantly expressed forms, such as mutant or inappropriately expressed isoforms. In yet other embodiments, protein fusions having a toxic moiety are administered to ablate cells that aberrantly accumulate OSP.

In a preferred embodiment, the polypeptide administered is an OSP comprising an amino acid sequence of SEQ ID NO: 129-295, or a fusion protein, allelic variant, homolog, analog or derivative thereof. In a more preferred embodiment, the polypeptide is encoded by a nucleic acid molecule having a nucleotide sequence of SEQ ID NO: 1-128, or a part, allelic variant, substantially similar or hybridizing nucleic acid thereof.

Antibody, Agonist and Antagonist Administration

In another embodiment of the therapeutic methods of the present invention, a therapeutically effective amount of a pharmaceutical composition comprising an antibody (including fragment or derivative thereof) of the present invention is administered. As is well known, antibody compositions are administered, for example, to antagonize activity of OSP, or to target therapeutic agents to sites of OSP presence and/or accumulation. In a preferred embodiment, the antibody specifically binds to an OSP comprising an amino acid sequence of SEQ ID NO: 129-295, or a fusion protein, allelic variant, homolog, analog or derivative thereof. In a more preferred embodiment, the antibody specifically binds to an OSP encoded by a nucleic acid molecule having a nucleotide sequence of SEQ ID NO: 1-128, or a part, allelic variant, substantially similar or hybridizing nucleic acid thereof.

The present invention also provides methods for identifying modulators which bind to an OSP or have a modulatory effect on the expression or activity of an OSP. Modulators which decrease the expression or activity of OSP (antagonists) are believed to be useful in treating ovarian cancer. Such screening assays are known to those of skill in the art and include, without limitation, cell-based assays and cell-free assays. Small molecules predicted via computer imaging to specifically bind to regions of an OSP can also be designed, synthesized and tested for use in the imaging and treatment of ovarian cancer. Further, libraries of molecules can be screened for potential anticancer agents by assessing the ability of the molecule to bind to the OSPs identified herein. Molecules identified in the library as being capable of binding to an OSP are key candidates for further evaluation for use in the treatment of ovarian cancer. In a preferred embodiment, these molecules will downregulate expression and/or activity of an OSP in cells.

In another embodiment of the therapeutic methods of the present invention, a pharmaceutical composition comprising a non-antibody antagonist of OSP is administered. Antagonists of OSP can be produced using methods generally known in the art. In particular, purified OSP can be used to screen libraries of pharmaceutical agents, often combinatorial libraries of small molecules, to identify those that specifically bind and antagonize at least one activity of an OSP.

In other embodiments a pharmaceutical composition comprising an agonist of an OSP is administered. Agonists can be identified using methods analogous to those used to identify antagonists.

In a preferred embodiment, the antagonist or agonist specifically binds to and antagonizes or agonizes, respectively, an OSP comprising an amino acid sequence of SEQ ID NO: 129-295, or a fusion protein, allelic variant, homolog, analog or derivative thereof. In a more preferred embodiment, the antagonist or agonist specifically binds to and antagonizes or agonizes, respectively, an OSP encoded by a nucleic acid molecule having a nucleotide sequence of SEQ ID NO: 1-128, or a part, allelic variant, substantially similar or hybridizing nucleic acid thereof.

Targeting Ovarian Tissue

The invention also provides a method in which a polypeptide of the invention, or an antibody thereto, is linked to a therapeutic agent such that it can be delivered to the ovarian or to specific cells in the ovarian. In a preferred embodiment, an anti-OSP antibody is linked to a therapeutic agent and is administered to a patient in need of such therapeutic agent. The therapeutic agent may be a toxin, if ovarian tissue needs to be selectively destroyed. This would be useful for targeting and killing ovarian cancer cells. In another embodiment, the therapeutic agent may be a growth or differentiation factor, which would be useful for promoting ovarian cell function.

In another embodiment, an anti-OSP antibody may be linked to an imaging agent that can be detected using, e.g., magnetic resonance imaging, CT or PET. This would be useful for determining and monitoring ovarian function, identifying ovarian cancer tumors, and identifying noncancerous ovarian diseases.

EXAMPLES

Example 1a

Alternative Splice Variants

We identified gene transcripts using the Gencarta™ tools (Compugen Ltd., Tel Aviv, Israel) and a variety of public and proprietary databases. These splice variants are either sequences which differ from a previously defined sequence or new uses of known sequences. In general related variants are annotated as DEX0455_XXX.nt.1, DEX0455_XXX.nt.2, DEX0455_XXX.nt.3, etc. The variant DNA sequences encode proteins which differ from a previously defined protein sequence. In relation to the nucleotide sequence naming convention, protein variants are annotated as DEX0455_XXX.aa.1, DEX0455_XXX.aa.2, etc., wherein transcript DEX0455_XXX.nt.1 encodes protein DEX0455_XXX.aa.1. A single transcript may encode a protein from an alternate Open Reading Fram (ORF) which is designated DEX0455_XXX.orf.1. Additionally, multiple transcripts may encode for a single protein. In this case, DEX0455_XXX.nt.1 and DEX0455_XXX.nt.2 will both be associated with DEX0455_XXX.aa.1.

The mapping of the nucleic acid ("NT") SEQ ID NO; DEX ID; chromosomal location (if known); open reading frame (ORF) location; amino acid ("AA") SEQ ID NO; AA DEX ID; are shown in the table below.

| SEQ ID NO | DEX ID | Chromo Map | ORF Loc | SEQ ID NO | DEX ID |
|---|---|---|---|---|---|
| 1 | DEX0455_001.nt.1 | X; 47722965-47733965 | 1624-2937 | 129 | DEX0455_001.orf.1 |
| 1 | DEX0455_001.nt.1 | X; 47722965-47733965 | 322-1035 | 130 | DEX0455_001.aa.1 |
| 2 | DEX0455_002.nt.1 | 17q11.1 | 217-915 | 131 | DEX0455_002.aa.1 |
| 3 | DEX0455_003.nt.1 | 10p11.23 | 132-476 | 132 | DEX0455_003.aa.1 |
| 4 | DEX0455_004.nt.1 | 3q29 | 7357-7809 | 133 | DEX0455_004.orf.1 |
| 4 | DEX0455_004.nt.1 | 3q29 | 2974-5074 | 134 | DEX0455_004.aa.1 |
| 5 | DEX0455_004.nt.2 | 3q29 | 6201-6653 | 135 | DEX0455_004.orf.2 |
| 5 | DEX0455_004.nt.2 | 3q29 | 2968-5257 | 136 | DEX0455_004.aa.2 |
| 6 | DEX0455_005.nt.1 | 2q13 | 854-1267 | 137 | DEX0455_005.aa.1 |
| 7 | DEX0455_005.nt.2 | 2q13 | 853-1270 | 137 | DEX0455_005.aa.1 |
| 8 | DEX0455_006.nt.1 | 9q22.1 | 730-1266 | 138 | DEX0455_006.aa.1 |
| 9 | DEX0455_007.nt.1 | 19q13.41 | 1-882 | 139 | DEX0455_007.orf.1 |
| 9 | DEX0455_007.nt.1 | 19q13.41 | 1-885 | 140 | DEX0455_007.aa.1 |
| 10 | DEX0455_008.nt.1 | 4q27 | 869-1138 | 141 | DEX0455_008.aa.1 |
| 11 | DEX0455_009.nt.1 | 20p12.2 | 1-1123 | 142 | DEX0455_009.aa.1 |
| 12 | DEX0455_010.nt.1 | Un_6; 1484154-1498876 | 341-784 | 143 | DEX0455_010.orf.1 |
| 12 | DEX0455_010.nt.1 | Un_6; 1484154-1498876 | 151-370 | 144 | DEX0455_010.aa.1 |
| 13 | DEX0455_010.nt.2 | Un_6; 1484154-1498876 | 49-621 | 145 | DEX0455_010.orf.2 |
| 13 | DEX0455_010.nt.2 | Un_6; 1484154-1498876 | 151-490 | 146 | DEX0455_010.aa.2 |
| 14 | DEX0455_011.nt.1 | 19q13.31 | 1-384 | 147 | DEX0455_011.aa.1 |
| 15 | DEX0455_012.nt.1 | 1q32.1 | 207-974 | 148 | DEX0455_012.aa.1 |
| 16 | DEX0455_012.nt.2 | 1q32.1 | 102-851 | 149 | DEX0455_012.orf.2 |
| 16 | DEX0455_012.nt.2 | 1q32.1 | 206-1415 | 150 | DEX0455_012.aa.2 |
| 17 | DEX0455_013.nt.1 | 12p12.3 | 10-666 | 151 | DEX0455_013.aa.1 |
| 18 | DEX0455_013.nt.2 | 12p12.3 | 124-639 | 152 | DEX0455_013.aa.2 |
| 19 | DEX0455_014.nt.1 | 1q42.2 | 880-1866 | 153 | DEX0455_014.orf.1 |
| 19 | DEX0455_014.nt.1 | 1q42.2 | 82-1870 | 154 | DEX0455_014.aa.1 |
| 20 | DEX0455_015.nt.1 | 12q13.2 | 1-255 | 155 | DEX0455_015.aa.1 |
| 21 | DEX0455_016.nt.1 | 1p31.1 | 104-868 | 156 | DEX0455_016.aa.1 |
| 22 | DEX0455_017.nt.1 | 1p33 | 102-623 | 157 | DEX0455_017.aa.1 |
| 23 | DEX0455_018.nt.1 | 9q34.11 | 209-1270 | 158 | DEX0455_018.aa.1 |
| 24 | DEX0455_018.nt.2 | 9q34.11 | 682-2148 | 159 | DEX0455_018.aa.2 |
| 25 | DEX0455_019.nt.1 | 11q13.4 | 66-926 | 160 | DEX0455_019.aa.1 |
| 26 | DEX0455_020.nt.1 | 19p13.11 | 365-793 | 161 | DEX0455_020.aa.1 |
| 27 | DEX0455_020.nt.2 | 19p13.11 | 688-1035 | 162 | DEX0455_020.orf.2 |
| 27 | DEX0455_020.nt.2 | 19p13.11 | 474-678 | 163 | DEX0455_020.aa.2 |
| 28 | DEX0455_021.nt.1 | 1p36.11 | 175-486 | 164 | DEX0455_021.orf.1 |
| 28 | DEX0455_021.nt.1 | 1p36.11 | 1-250 | 165 | DEX0455_021.aa.1 |
| 29 | DEX0455_021.nt.2 | 1p36.11 | 190-1269 | 166 | DEX0455_021.aa.2 |
| 30 | DEX0455_021.nt.3 | 1p36.11 | 46-1173 | 167 | DEX0455_021.orf.3 |

-continued

| SEQ ID NO | DEX ID | Chromo Map | ORF Loc | SEQ ID NO | DEX ID |
|---|---|---|---|---|---|
| 30 | DEX0455_021.nt.3 | 1p36.11 | 189-1590 | 168 | DEX0455_021.aa.3 |
| 31 | DEX0455_021.nt.4 | 1p36.11 | 190-1173 | 169 | DEX0455_021.aa.4 |
| 32 | DEX0455_022.nt.1 | 19p13.12 | 109-642 | 170 | DEX0455_022.aa.1 |
| 33 | DEX0455_022.nt.2 | 19p13.12 | 70-492 | 171 | DEX0455_022.orf.2 |
| 33 | DEX0455_022.nt.2 | 19p13.12 | 108-675 | 172 | DEX0455_022.aa.2 |
| 34 | DEX0455_022.nt.3 | 19p13.12 | 91-324 | 173 | DEX0455_022.aa.3 |
| 35 | DEX0455_023.nt.1 | 7q11.21 | 609-956 | 174 | DEX0455_023.aa.1 |
| 36 | DEX0455_024.nt.1 | 2p13.3 | 486-1569 | 175 | DEX0455_024.aa.1 |
| 37 | DEX0455_024.nt.2 | 2p13.3 | 469-999 | 176 | DEX0455_024.aa.2 |
| 38 | DEX0455_025.nt.1 | 17q24.3 | 475-1614 | 177 | DEX0455_025.aa.1 |
| 39 | DEX0455_025.nt.2 | 17q24.3 | 328-1509 | 178 | DEX0455_025.orf.2 |
| 39 | DEX0455_025.nt.2 | 17q24.3 | 474-2514 | 179 | DEX0455_025.aa.2 |
| 40 | DEX0455_025.nt.3 | 17q24.3 | 474-1617 | 177 | DEX0455_025.aa.1 |
| 41 | DEX0455_025.nt.4 | 17q24.3 | 474-1617 | 177 | DEX0455_025.aa.1 |
| 42 | DEX0455_026.nt.1 | 2q32.2 | 3-218 | 180 | DEX0455_026.orf.1 |
| 42 | DEX0455_026.nt.1 | 2q32.2 | 1-236 | 181 | DEX0455_026.aa.1 |
| 43 | DEX0455_027.nt.1 | 2q24.3 | 986-1507 | 182 | DEX0455_027.orf.1 |
| 43 | DEX0455_027.nt.1 | 2q24.3 | 16-128 | 183 | DEX0455_027.aa.1 |
| 44 | DEX0455_028.nt.1 | 9p24.3 | 141-785 | 184 | DEX0455_028.aa.1 |
| 45 | DEX0455_029.nt.1 | 9q21.11 | 4134-4532 | 185 | DEX0455_029.orf.1 |
| 45 | DEX0455_029.nt.1 | 9q21.11 | 2985-5847 | 186 | DEX0455_029.aa.1 |
| 46 | DEX0455_029.nt.2 | 9q21.11 | 4562-5143 | 187 | DEX0455_029.orf.2 |
| 46 | DEX0455_029.nt.2 | 9q21.11 | 2962-5149 | 188 | DEX0455_029.aa.2 |
| 47 | DEX0455_030.nt.1 | 16p11.2 | 188-1123 | 189 | DEX0455_030.aa.1 |
| 48 | DEX0455_030.nt.2 | 16p11.2 | 82-627 | 190 | DEX0455_030.aa.2 |
| 49 | DEX0455_031.nt.1 | 12p13.31 | 135-1013 | 191 | DEX0455_031.orf.1 |
| 49 | DEX0455_031.nt.1 | 12p13.31 | 248-2156 | 192 | DEX0455_031.aa.1 |
| 50 | DEX0455_031.nt.2 | 12p13.31 | 248-749 | 193 | DEX0455_031.aa.2 |
| 50 | DEX0455_031.nt.2 | 12p13.31 | 1325-2239 | 194 | DEX0455_031.orf.2 |
| 51 | DEX0455_031.nt.3 | 12p13.31 | 1-582 | 195 | DEX0455_031.aa.3 |
| 52 | DEX0455_032.nt.1 | 7q31.1 | 39-761 | 196 | DEX0455_032.aa.1 |
| 53 | DEX0455_033.nt.1 | 1p34.1 | 161-943 | 197 | DEX0455_033.aa.1 |
| 54 | DEX0455_034.nt.1 | 15q21.1 | 197-1693 | 198 | DEX0455_034.aa.1 |
| 55 | DEX0455_034.nt.2 | 15q21.1 | 1-1497 | 198 | DEX0455_034.aa.1 |
| 56 | DEX0455_034.nt.3 | 15q21.1 | 197-1228 | 199 | DEX0455_034.aa.3 |
| 57 | DEX0455_034.nt.4 | 15q21.1 | 2-1438 | 200 | DEX0455_034.aa.4 |
| 58 | DEX0455_035.nt.1 | 10q22.1 | 102-464 | 201 | DEX0455_035.aa.1 |
| 59 | DEX0455_035.nt.2 | 10q22.1 | 755-1201 | 202 | DEX0455_035.orf.2 |
| 59 | DEX0455_035.nt.2 | 10q22.1 | 330-696 | 203 | DEX0455_035.aa.2 |
| 60 | DEX0455_035.nt.3 | 10q22.1 | 634-1080 | 204 | DEX0455_035.orf.3 |
| 60 | DEX0455_035.nt.3 | 10q22.1 | 269-575 | 205 | DEX0455_035.aa.3 |
| 61 | DEX0455_036.nt.1 | 19p13.2 | 86-370 | 206 | DEX0455_036.orf.1 |
| 61 | DEX0455_036.nt.1 | 19p13.2 | 58-389 | 207 | DEX0455_036.aa.1 |
| 62 | DEX0455_036.nt.2 | 19p13.2 | 295-4749 | 208 | DEX0455_036.aa.2 |
| 63 | DEX0455_036.nt.3 | 19p13.2 | 3-335 | 209 | DEX0455_036.orf.3 |
| 63 | DEX0455_036.nt.3 | 19p13.2 | 88-352 | 210 | DEX0455_036.aa.3 |
| 64 | DEX0455_036.nt.4 | 19p13.2 | 77-352 | 211 | DEX0455_036.orf.4 |
| 64 | DEX0455_036.nt.4 | 19p13.2 | 1-253 | 212 | DEX0455_036.aa.4 |
| 65 | DEX0455_037.nt.1 | 9 | 113-787 | 213 | DEX0455_037.aa.1 |
| 66 | DEX0455_037.nt.2 | 9 | 2-1048 | 214 | DEX0455_037.orf.2 |
| 66 | DEX0455_037.nt.2 | 9 | 112-1354 | 215 | DEX0455_037.aa.2 |
| 67 | DEX0455_037.nt.3 | 9 | 113-1342 | 216 | DEX0455_037.aa.3 |
| 68 | DEX0455_037.nt.4 | 9 | 2-410 | 217 | DEX0455_037.aa.4 |
| 69 | DEX0455_037.nt.5 | 9 | 3-452 | 218 | DEX0455_037.aa.5 |
| 70 | DEX0455_037.nt.6 | 9 | 113-784 | 219 | DEX0455_037.aa.6 |
| 71 | DEX0455_037.nt.7 | 9 | 113-1555 | 220 | DEX0455_037.aa.7 |
| 72 | DEX0455_038.nt.1 | 20p12.1 | 298-3561 | 221 | DEX0455_038.aa.1 |
| 73 | DEX0455_038.nt.2 | 20p12.1 | 298-3564 | 221 | DEX0455_038.aa.1 |
| 74 | DEX0455_038.nt.3 | 20p12.1 | 1-1320 | 222 | DEX0455_038.orf.3 |
| 74 | DEX0455_038.nt.3 | 20p12.1 | 298-1863 | 223 | DEX0455_038.aa.3 |
| 75 | DEX0455_039.nt.1 | 19q13.2 | 2-496 | 224 | DEX0455_039.aa.1 |
| 76 | DEX0455_039.nt.2 | 19q13.2 | 2-787 | 225 | DEX0455_039.aa.2 |
| 77 | DEX0455_040.nt.1 | 19q13.2 | 299-991 | 226 | DEX0455_040.orf.1 |
| 77 | DEX0455_040.nt.1 | 19q13.2 | 352-991 | 227 | DEX0455_040.aa.1 |
| 78 | DEX0455_040.nt.2 | 19q13.2 | 770-1495 | 228 | DEX0455_040.aa.2 |
| 79 | DEX0455_041.nt.1 | 20q11.23 | 54-212 | 229 | DEX0455_041.orf.1 |
| 79 | DEX0455_041.nt.1 | 20q11.23 | 7-138 | 230 | DEX0455_041.aa.1 |
| 80 | DEX0455_041.nt.2 | 20q11.23 | 11-208 | 231 | DEX0455_041.orf.2 |
| 80 | DEX0455_041.nt.2 | 20q11.23 | 1-107 | 232 | DEX0455_041.aa.2 |
| 81 | DEX0455_042.nt.1 | 4q22.1 | 90-437 | 233 | DEX0455_042.orf.1 |
| 81 | DEX0455_042.nt.1 | 4q22.1 | 70-439 | 234 | DEX0455_042.aa.1 |
| 82 | DEX0455_043.nt.1 | 1q42.12 | 511-768 | 235 | DEX0455_043.orf.1 |
| 82 | DEX0455_043.nt.1 | 1q42.12 | 1-93 | 236 | DEX0455_043.aa.1 |
| 83 | DEX0455_043.nt.2 | 1q42.12 | 413-787 | 237 | DEX0455_043.orf.2 |
| 83 | DEX0455_043.nt.2 | 1q42.12 | 1-93 | 236 | DEX0455_043.aa.1 |
| 84 | DEX0455_043.nt.3 | 1q42.12 | 1220-1531 | 238 | DEX0455_043.orf.3 |

| SEQ ID NO | DEX ID | Chromo Map | ORF Loc | SEQ ID NO | DEX ID |
|---|---|---|---|---|---|
| 84 | DEX0455_043.nt.3 | 1q42.12 | 1-93 | 236 | DEX0455_043.aa.1 |
| 85 | DEX0455_044.nt.1 | 17q25.3 | 445-627 | 239 | DEX0455_044.aa.1 |
| 86 | DEX0455_045.nt.1 | 16p12.3 | 1-579 | 240 | DEX0455_045.orf.1 |
| 86 | DEX0455_045.nt.1 | 16p12.3 | 1-492 | 241 | DEX0455_045.aa.1 |
| 87 | DEX0455_046.nt.1 | 17q21.32 | 709-1389 | 242 | DEX0455_046.orf.1 |
| 87 | DEX0455_046.nt.1 | 17q21.32 | 802-1389 | 243 | DEX0455_046.aa.1 |
| 88 | DEX0455_047.nt.1 | 8p23.1 | 2887-3195 | 244 | DEX0455_047.orf.1 |
| 88 | DEX0455_047.nt.1 | 8p23.1 | 136-334 | 245 | DEX0455_047.aa.1 |
| 89 | DEX0455_047.nt.2 | 8p23.1 | 1091-1399 | 246 | DEX0455_047.orf.2 |
| 89 | DEX0455_047.nt.2 | 8p23.1 | 19-102 | 247 | DEX0455_047.aa.2 |
| 90 | DEX0455_048.nt.1 | X; 150645762-150649651 | 84-545 | 248 | DEX0455_048.aa.1 |
| 91 | DEX0455_048.nt.2 | X; 150645762-150649651 | 286-813 | 249 | DEX0455_048.orf.2 |
| 91 | DEX0455_048.nt.2 | X; 150645762-150649651 | 1-817 | 250 | DEX0455_048.aa.2 |
| 92 | DEX0455_049.nt.1 | 2p21 | 1183-1986 | 251 | DEX0455_049.aa.1 |
| 93 | DEX0455_049.nt.2 | 2p21 | 378-1403 | 252 | DEX0455_049.aa.2 |
| 94 | DEX0455_049.nt.3 | 2p21 | 808-1527 | 253 | DEX0455_049.aa.3 |
| 95 | DEX0455_049.nt.4 | 2p21 | 1-1170 | 254 | DEX0455_049.aa.4 |
| 96 | DEX0455_049.nt.5 | 2p21 | 179-1120 | 255 | DEX0455_049.aa.5 |
| 97 | DEX0455_050.nt.1 | 7p22.1 | 186-551 | 256 | DEX0455_050.orf.1 |
| 97 | DEX0455_050.nt.1 | 7p22.1 | 1-149 | 257 | DEX0455_050.aa.1 |
| 98 | DEX0455_051.nt.1 | 19 | 1-1788 | 258 | DEX0455_051.aa.1 |
| 99 | DEX0455_051.nt.2 | 19 | 1-1224 | 259 | DEX0455_051.aa.2 |
| 100 | DEX0455_051.nt.3 | 19 | 1-1410 | 260 | DEX0455_051.aa.3 |
| 101 | DEX0455_051.nt.4 | 19 | 1-1224 | 259 | DEX0455_051.aa.2 |
| 101 | DEX0455_051.nt.4 | 19 | 1-1422 | 261 | DEX0455_051.orf.4 |
| 102 | DEX0455_051.nt.5 | 19 | 1-1224 | 259 | DEX0455_051.aa.2 |
| 102 | DEX0455_051.nt.5 | 19 | 1-1422 | 262 | DEX0455_051.orf.5 |
| 103 | DEX0455_051.nt.6 | 19 | 1-1224 | 259 | DEX0455_051.aa.2 |
| 103 | DEX0455_051.nt.6 | 19 | 1-1422 | 263 | DEX0455_051.orf.6 |
| 104 | DEX0455_052.nt.1 | 19 | 13-1422 | 264 | DEX0455_052.aa.1 |
| 105 | DEX0455_052.nt.2 | 19 | 13-1518 | 265 | DEX0455_052.aa.2 |
| 106 | DEX0455_052.nt.3 | 19 | 188-1831 | 266 | DEX0455_052.aa.3 |
| 107 | DEX0455_052.nt.4 | 19 | 100-930 | 267 | DEX0455_052.aa.4 |
| 108 | DEX0455_053.nt.1 | 1p12 | 1-846 | 268 | DEX0455_053.aa.1 |
| 109 | DEX0455_053.nt.2 | 1p12 | 1-177 | 269 | DEX0455_053.aa.2 |
| 109 | DEX0455_053.nt.2 | 1p12 | 253-1008 | 270 | DEX0455_053.aa.3 |
| 110 | DEX0455_054.nt.1 | 15q24.3 | 1218-1682 | 271 | DEX0455_054.orf.1 |
| 110 | DEX0455_054.nt.1 | 15q24.3 | 1038-1362 | 272 | DEX0455_054.aa.1 |
| 111 | DEX0455_054.nt.2 | 15q24.3 | 410-874 | 273 | DEX0455_054.orf.2 |
| 111 | DEX0455_054.nt.2 | 15q24.3 | 122-554 | 274 | DEX0455_054.aa.2 |
| 112 | DEX0455_055.nt.1 | 1 | 812-1570 | 275 | DEX0455_055.aa.1 |
| 113 | DEX0455_055.nt.2 | 1 | 388-1470 | 276 | DEX0455_055.aa.2 |
| 114 | DEX0455_055.nt.3 | 1p34.2 | 402-902 | 277 | DEX0455_055.aa.3 |
| 115 | DEX0455_056.nt.1 | 7q31.1 | 626-2533 | 278 | DEX0455_056.orf.1 |
| 115 | DEX0455_056.nt.1 | 7q31.1 | 670-3283 | 279 | DEX0455_056.aa.1 |
| 116 | DEX0455_056.nt.2 | 7q31.1 | 671-3043 | 280 | DEX0455_056.aa.2 |
| 117 | DEX0455_057.nt.1 | 1q21.3 | 146-511 | 281 | DEX0455_057.orf.1 |
| 117 | DEX0455_057.nt.1 | 1q21.3 | 1-513 | 282 | DEX0455_057.aa.1 |
| 118 | DEX0455_057.nt.2 | 1q21.3 | 405-681 | 283 | DEX0455_057.aa.2 |
| 119 | DEX0455_058.nt.1 | 1q42.12 | 1208-1405 | 284 | DEX0455_058.orf.1 |
| 119 | DEX0455_058.nt.1 | 1q42.12 | 315-513 | 285 | DEX0455_058.aa.1 |
| 120 | DEX0455_059.nt.1 | 19p13.11 | 294-1382 | 286 | DEX0455_059.orf.1 |
| 120 | DEX0455_059.nt.1 | 19p13.11 | 1-352 | 287 | DEX0455_059.aa.1 |
| 121 | DEX0455_059.nt.2 | 19p13.11 | 596-1093 | 288 | DEX0455_059.orf.2 |
| 121 | DEX0455_059.nt.2 | 19p13.11 | 1-352 | 287 | DEX0455_059.aa.1 |
| 122 | DEX0455_060.nt.1 | 21q21.1 | 3-623 | 289 | DEX0455_060.aa.1 |
| 123 | DEX0455_061.nt.1 | 10q11.21 | 1564-2619 | 290 | DEX0455_061.aa.1 |
| 124 | DEX0455_061.nt.2 | 10q11.21 | 2449-3231 | 291 | DEX0455_061.aa.2 |
| 125 | DEX0455_061.nt.3 | 10q11.21 | 2449-3255 | 292 | DEX0455_061.aa.3 |
| 126 | DEX0455_061.nt.4 | 10q11.21 | 1045-1443 | 293 | DEX0455_061.aa.4 |
| 127 | DEX0455_061.nt.5 | 10q11.21 | 842-1330 | 294 | DEX0455_061.orf.5 |
| 127 | DEX0455_061.nt.5 | 10q11.21 | 1740-2142 | 293 | DEX0455_061.aa.4 |
| 128 | DEX0455_062.nt.1 | 2p25.1 | 120-1592 | 295 | DEX0455_062.aa.1 |

The polypeptides of the present invention were analyzed and the following attributes were identified; specifically, epitopes, post translational modifications, signal peptides and transmembrane domains. Antigenicity (Epitope) prediction was performed through the antigenic module in the EMBOSS package. Rice, P., EMBOSS: The European Molecular Biology Open Software Suite, *Trends in Genetics* 16(6): 276-277 (2000). The antigenic module predicts potentially antigenic regions of a protein sequence, using the method of Kolaskar and Tongaonkar. Kolaskar, A S and Tongaonkar, P C., A semi-empirical method for prediction of antigenic determinants on protein antigens, *FEBS Letters* 276: 172-174 (1990). Examples of post-translational modifications (PTMs) and other motifs of the OSPs of this invention are listed below. In addition, antibodies that specifically bind such post-translational modifications may be useful as a diagnostic or as therapeutic. The PTMs and other motifs were predicted by using the ProSite Dictionary of Proteins Sites and Patterns (Bairoch et al., *Nucleic Acids Res.* 25(1):217-221 (1997)), the following motifs, including PTMs, were predicted for the OSPs of the invention. The signal peptides were detected by using the SignalP 2.0, see Nielsen et al., *Protein Engineering* 12, 3-9 (1999). Prediction of transmembrane helices in proteins was performed by the application TMHMM 2.0, "currently the best performing transmembrane prediction program", according to authors (Krogh et al., *Journal of Molecular Biology,* 305(3):567-580, (2001); Moller et al., *Bioinformatics,* 17(7):646-653, (2001); Sonnhammer, et al., *A hidden Markov model for predicting transmembrane helices in protein sequences* in Glasgow, et al. Ed. *Proceedings of the Sixth International Conference on Intelligent Systems for Molecular Biology*, pages 175-182, Menlo Park, Calif., 1998. AAAI Press. The PSORT II program may also be used to predict cellular localizations. Horton et al., *Intelligent Systems for Molecular Biology* 5: 147-152 (1997). The table below includes the following sequence annotations: Signal peptide presence; TM (number of membrane domain, topology in orientation and position); Amino acid location and antigenic index (location, AI score); PTM and other motifs (type, amino acid residue locations); and functional domains (type, amino acid residue locations).

| DEX ID | Sig P | TMHMM | Antigenicity | PTM | Domains |
|---|---|---|---|---|---|
| DEX0455_001.orf.1 | N | 0 - o1-438; | 333-345, 1.127; 155-162, 1.105; 184-208, 1.14; 231-239, 1.049; 56-63, 1.067; 170-176, 1.117; 38-47, 1.115; 75-81, 1.069; 108-119, 1.16; 305-311, 1.041; 273-283, 1.106; 241-256, 1.161; 4-36, 1.186; 323-329, 1.094; 290-302, 1.123; 383-435, 1.147; 122-131, 1.09; 211-217, 1.039; | CK2_PHOSPHO_SITE 104-107; PKC_PHOSPHO_SITE 284-286; CAMP_PHOSPHO_SITE 85-88; CK2_PHOSPHO_SITE 352-355; CK2_PHOSPHO_SITE 43-46; PKC_PHOSPHO_SITE 430-432; MYRISTYL 138-143; MYRISTYL 265-270; ASN_GLYCOSYLATION 167-170; PKC_PHOSPHO_SITE 216-218; MYRISTYL 260-265; TYR_PHOSPHO_SITE 200-206; MYRISTYL 179-184; PKC_PHOSPHO_SITE 84-86; PKC_PHOSPHO_SITE 153-155; PKC_PHOSPHO_SITE 163-165; CK2_PHOSPHO_SITE 284-287; MYRISTYL 267-272; | PRICHEXTENSN 111-128; PRO_RICH_2 185-351; PRICHEXTENSN 1-13; PRICHEXTENSN 63-75; PRICHEXTENSN 206-231; PRO_RICH_1 1-75; |
| DEX0455_001.aa.1 | N | 0 - o1-237; | 164-217, 1.189; 14-30, 1.076; 79-85, 1.054; 64-74, 1.136; 148-161, 1.094; 89-114, 1.145; 116-138, 1.139; 43-61, 1.159; 33-39, 1.034; 4-11, 1.088; | MYRISTYL 194-199; MYRISTYL 5-10; PKC_PHOSPHO_SITE 88-90; PKC_PHOSPHO_SITE 47-49; CK2_PHOSPHO_SITE 41-44; LEUCINE_ZIPPER 157-178; MYRISTYL 198-203; PKC_PHOSPHO_SITE 29-31; MYRISTYL 187-192; PKC_PHOSPHO_SITE 235-237; CK2_PHOSPHO_SITE 205-208; | |
| DEX0455_002.aa.1 | N | 0 - o1-233; | 174-212, 1.218; 88-148, 1.133; 153-158, 1.07; 67-81, 1.137; 46-65, 1.141; 9-44, 1.202; | CK2_PHOSPHO_SITE 159-162; MYRISTYL 139-144; MYRISTYL 112-117; MYRISTYL 83-88; ASN_GLYCOSYLATION 47-50; MYRISTYL 181-186; MYRISTYL 61-66; | TONB_DEPENDENT_REC_1 1-49; GALAPTIN 165-186; GLECT 103-233; Gal-bind_lectin 104-233; |
| DEX0455_003.aa.1 | N | 0 - o1-115; | 9-18, 1.083; 30-51, 1.14; 56-82, 1.155; 104-111, 1.084; | CAMP_PHOSPHO_SITE 21-24; CK2_PHOSPHO_SITE 24-27; MYRISTYL 57-62; PKC_PHOSPHO_SITE 32-34; CK2_PHOSPHO_SITE 43-46; MYRISTYL 25-30; PKC_PHOSPHO_SITE 4-6; AMIDATION 101-104; PKC_PHOSPHO_SITE 93-95; PKC_PHOSPHO_SITE 109-111; AMIDATION 4-7; | ARG_RICH 18-104; |

-continued

| DEX ID | Sig P | TMHMM | Antigenicity | PTM | Domains |
|---|---|---|---|---|---|
| DEX0455_004.orf.1 | N | 1 - o1-54; tm55-74; i75-151; | 112-143, 1.199; 5-12, 1.074; 40-104, 1.27; 14-37, 1.097; | MYRISTYL 96-101; PKC_PHOSPHO_SITE 145-147; MYRISTYL 82-87; MYRISTYL 105-110; PKC_PHOSPHO_SITE 25-27; CK2_PHOSPHO_SITE 143-146; | |
| DEX0455_004.aa.1 | N | 2 - o1-594; tm595-617; i618-666; tm667-689; o690-699; | 245-261, 1.17; 51-68, 1.161; 429-437, 1.15; 202-222, 1.139; 533-553, 1.095; 102-115, 1.182; 186-193, 1.076; 121-140, 1.245; 333-341, 1.129; 375-383, 1.117; 265-319, 1.148; 142-174, 1.138; 70-98, 1.151; 345-354, 1.089; 579-588, 1.236; 445-458, 1.242; 515-531, 1.129; 398-405, 1.098; 690-696, 1.182; 593-617, 1.232; 224-243, 1.183; 629-688, 1.194; 408-413, 1.058; 475-512, 1.147; 462-473, 1.227; 23-34, 1.175; 363-369, 1.038; | CK2_PHOSPHO_SITE 440-443; CK2_PHOSPHO_SITE 36-39; PKC_PHOSPHO_SITE 641-643; MYRISTYL 264-269; PKC_PHOSPHO_SITE 28-30; ASN_GLYCOSYLATION 471-474; ASN_GLYCOSYLATION 628-631; MYRISTYL 591-596; PKC_PHOSPHO_SITE 210-212; CAMP_PHOSPHO_SITE 15-18; ASN_GLYCOSYLATION 569-572; CK2_PHOSPHO_SITE 140-143; PKC_PHOSPHO_SITE 302-304; MYRISTYL 557-562; AMIDATION 19-22; ASN_GLYCOSYLATION 297-300; AMIDATION 197-200; CAMP_PHOSPHO_SITE 587-590; CK2_PHOSPHO_SITE 542-545; PKC_PHOSPHO_SITE 420-422; PKC_PHOSPHO_SITE 70-72; MYRISTYL 530-535; PKC_PHOSPHO_SITE 560-562; MYRISTYL 256-261; CAMP_PHOSPHO_SITE 16-19; MYRISTYL 625-630; PKC_PHOSPHO_SITE 527-529; MYRISTYL 93-98; PKC_PHOSPHO_SITE 19-21; PKC_PHOSPHO_SITE 514-516; TYR_PHOSPHO_SITE 149-155; | RIBOSOMAL_S2_1 245-256; LYS_RICH 9-22; |
| DEX0455_004.orf.2 | N | 1 - o1-54; tm55-74; i75-151; | 14-37, 1.097; 40-104, 1.27; 112-143, 1.199; 5-12, 1.074; | CK2_PHOSPHO_SITE 143-146; MYRISTYL 96-101; PKC_PHOSPHO_SITE 25-27; MYRISTYL 105-110; MYRISTYL 82-87; PKC_PHOSPHO_SITE 145-147; | |
| DEX0455_004.aa.2 | N | 9 - o1-210; tm211-233; i234-282; tm283-305; o306-324; tm325-347; i348-367; tm368-385; o386-543; tm544-566; i567-578; tm579-599; o600-613; tm614-633; i634-679; | 713-724, 1.168; 19-28, 1.088; 131-153, 1.129; 746-755, 1.027; 209-233, 1.232; 604-653, 1.189; 78-89, 1.227; 484-491, 1.123; 402-459, 1.205; | PKC_PHOSPHO_SITE 257-259; MYRISTYL 14-19; MYRISTYL 173-178; CK2_PHOSPHO_SITE 676-679; PKC_PHOSPHO_SITE 620-622; PKC_PHOSPHO_SITE 143-145; ASN_GLYCOSYLATION 418-421; PKC_PHOSPHO_SITE 176-178; MYRISTYL 207-212; ASN_GLYCOSYLATION 87-90; CAMP_PHOSPHO_SITE 203-206; MYRISTYL 161-166; MYRISTYL 13-18; ASN_GLYCOSYLATION 493-496; MYRISTYL 691-696; TYR_PHOSPHO_SITE 755-761; PKC_PHOSPHO_SITE 676-678; MYRISTYL 241-246; | N4_MTASE 609-614; |

-continued

| DEX ID | Sig P | TMHMM | Antigenicity | PTM | Domains |
|---|---|---|---|---|---|
| | | tm680-699; o700-703; tm704-721; i722-762; | 497-519, 1.232; 367-394, 1.253; 195-204, 1.236; 91-128, 1.147; 657-705, 1.254; 245-313, 1.194; 577-601, 1.285; 555-569, 1.252; 523-553, 1.135; 737-744, 1.1; 61-74, 1.242; 156-169, 1.143; 45-53, 1.15; 323-353, 1.237; 472-480, 1.153; | ASN_GLYCOSYLATION 363-366; CK2_PHOSPHO_SITE 466-469; PKC_PHOSPHO_SITE 594-596; ASN_GLYCOSYLATION 312-315; ASN_GLYCOSYLATION 244-247; CK2_PHOSPHO_SITE 56-59; CK2_PHOSPHO_SITE 320-323; CK2_PHOSPHO_SITE 506-509; PKC_PHOSPHO_SITE 425-427; PKC_PHOSPHO_SITE 721-723; MYRISTYL 712-717; PKC_PHOSPHO_SITE 130-132; ASN_GLYCOSYLATION 185-188; PKC_PHOSPHO_SITE 506-508; | |
| DEX0455_005.aa.1 | N | 0 - o1-138; | 19-29, 1.121; 125-132, 1.063; 4-9, 1.045; 45-61, 1.116; 88-107, 1.22; 76-85, 1.064; | PKC_PHOSPHO_SITE 87-89; MYRISTYL 21-26; PKC_PHOSPHO_SITE 131-133; MYRISTYL 102-107; CK2_PHOSPHO_SITE 38-41; CK2_PHOSPHO_SITE 29-32; | |
| DEX0455_006.aa.1 | N | 0 - o1-179; | 34-45, 1.149; 92-99, 1.162; 8-14, 1.034; 117-135, 1.172; 49-61, 1.175; 168-176, 1.097; 104-110, 1.069; 77-85, 1.119; 143-155, 1.15; | CAMP_PHOSPHO_SITE 62-65; CK2_PHOSPHO_SITE 110-113; AMIDATION 138-141; CK2_PHOSPHO_SITE 67-70; TYR_PHOSPHO_SITE 88-95; CK2_PHOSPHO_SITE 74-77; PKC_PHOSPHO_SITE 112-114; MYRISTYL 36-41; CAMP_PHOSPHO_SITE 127-130; CK2_PHOSPHO_SITE 106-109; MYRISTYL 133-138; | |
| DEX0455_007.orf.1 | N | 0 - o1-294; | 4-23, 1.139; 194-201, 1.095; 133-176, 1.151; 39-45, 1.069; 58-68, 1.056; 244-261, 1.123; 78-120, 1.147; | PKC_PHOSPHO_SITE 24-26; CK2_PHOSPHO_SITE 71-74; MYRISTYL 231-236; CK2_PHOSPHO_SITE 203-206; PKC_PHOSPHO_SITE 270-272; PKC_PHOSPHO_SITE 131-133; CK2_PHOSPHO_SITE 189-192; MYRISTYL 278-283; CK2_PHOSPHO_SITE 24-27; MYRISTYL 201-206; MYRISTYL 266-271; MYRISTYL 120-125; CK2_PHOSPHO_SITE 56-59; CAMP_PHOSPHO_SITE 132-135; | |
| DEX0455_007.aa.1 | N | 0 - o1-294; | 4-23, 1.139; 133-176, 1.151; 194-201, 1.095; 39-45, 1.069; 244-261, 1.123; 58-68, 1.056; | MYRISTYL 266-271; CAMP_PHOSPHO_SITE 132-135; PKC_PHOSPHO_SITE 131-133; MYRISTYL 278-283; CK2_PHOSPHO_SITE 24-27; MYRISTYL 120-125; CK2_PHOSPHO_SITE 189-192; MYRISTYL 201-206; CK2_PHOSPHO_SITE 71-74; PKC_PHOSPHO_SITE 270-272; | |

-continued

| DEX ID | Sig P | TMHMM | Antigenicity | PTM | Domains |
|---|---|---|---|---|---|
| | | | 78-120, 1.147; | CK2_PHOSPHO_SITE 203-206; MYRISTYL 231-236; PKC_PHOSPHO_SITE 24-26; CK2_PHOSPHO_SITE 56-59; | |
| DEX0455_008.aa.1 | N | 0 - o1-90; | 43-78, 1.171; 16-37, 1.092; | CK2_PHOSPHO_SITE 57-60; PKC_PHOSPHO_SITE 79-81; MYRISTYL 36-41; CAMP_PHOSPHO_SITE 81-84; PKC_PHOSPHO_SITE 12-14; | HORMA 14-72; |
| DEX0455_009.aa.1 | N | 1 - o1-328; tm329-351; i352-373; | 189-217, 1.126; 139-145, 1.097; 258-270, 1.167; 38-61, 1.154; 272-286, 1.083; 156-177, 1.157; 73-122, 1.145; 231-240, 1.152; 289-321, 1.16; 328-354, 1.187; 4-32, 1.238; 247-253, 1.064; | MYRISTYL 335-340; MYRISTYL 83-88; PKC_PHOSPHO_SITE 241-243; ASN_GLYCOSYLATION 146-149; MYRISTYL 34-39; MYRISTYL 32-37; PKC_PHOSPHO_SITE 228-230; AMIDATION 51-54; PKC_PHOSPHO_SITE 4-6; CK2_PHOSPHO_SITE 195-198; ASN_GLYCOSYLATION 220-223; PKC_PHOSPHO_SITE 13-15; CK2_PHOSPHO_SITE 134-137; | LAMP_1 149-163; LYSASSOCTDMP 139-163; LYSASSOCTDMP 267-281; |
| DEX0455_010.orf.1 | N | 1 - o1-109; tm110-132; i133-148; | 51-57, 1.138; 78-98, 1.159; 111-132, 1.193; 4-41, 1.243; 67-75, 1.122; | MYRISTYL 57-62; MYRISTYL 52-57; MYRISTYL 140-145; | IG_LIKE 8-112; IGc1 23-94; ig 21-86; IG_MHC 82-88; |
| DEX0455_010.aa.1 | N | 0 - o1-72; | 4-12, 1.148; 34-44, 1.09; 55-69, 1.084; 22-28, 1.112; | TYR_PHOSPHO_SITE 50-58; CK2_PHOSPHO_SITE 37-40; PKC_PHOSPHO_SITE 37-39; | sp_P13761_HB2J_HUMAN 43-70; |
| DEX0455_010.orf.2 | Y | 2 - o1-14; tm15-37; i38-152; tm153-175; o176-191; | 94-100, 1.138; 4-84, 1.243; 154-175, 1.193; 121-141, 1.159; 110-118, 1.122; | MYRISTYL 24-29; MYRISTYL 95-100; MYRISTYL 100-105; MYRISTYL 183-188; | IGc1 66-137; ig 64-129; IG_MHC 125-131; IG_LIKE 51-155; |
| DEX0455_010.aa.2 | N | 0 - o1-112; | 87-103, 1.09; 60-66, 1.138; 4-50, 1.243; 76-84, 1.122; | MYRISTYL 107-112; MYRISTYL 61-66; MYRISTYL 66-71; CK2_PHOSPHO_SITE 106-109; MYRISTYL 96-101; | IG_LIKE 17-112; IGc1 32-103; ig 30-95; |
| DEX0455_011.aa.1 | N | 0 - o1-128; | 78-97, 1.118; 99-115, 1.098; 7-33, 1.125; 37-43, 1.08; 118-125, 1.159; | PKC_PHOSPHO_SITE 82-84; ASN_GLYCOSYLATION 48-51; CAMP_PHOSPHO_SITE 66-69; MYRISTYL 59-64; ASN_GLYCOSYLATION 58-61; CK2_PHOSPHO_SITE 34-37; | GALAPTIN 61-81; SUI1_1 115-122; GLECT 4-128; Gal-bind_lectin 1-128; |
| DEX0455_012.aa.1 | N | 0 - o1-256; | 136-143, 1.08; 193-199, 1.037; 176-189, 1.099; 69-82, 1.102; 38-45, 1.131; 87-93, 1.067; 4-9, 1.066; | CK2_PHOSPHO_SITE 20-23; CK2_PHOSPHO_SITE 215-218; MYRISTYL 202-207; CK2_PHOSPHO_SITE 132-135; CK2_PHOSPHO_SITE 131-134; MYRISTYL 200-205; CK2_PHOSPHO_SITE 93-96; MYRISTYL 53-58; CK2_PHOSPHO_SITE 88-91; MYRISTYL 182-187; | SAM_PNT 48-132; SAM_PNT 48-132; |

-continued

| DEX ID | Sig P | TMHMM | Antigenicity | PTM | Domains |
|---|---|---|---|---|---|
| | | | 100-128, 1.153; 26-34, 1.129; 236-245, 1.062; | CAMP_PHOSPHO_SITE 237-240; MYRISTYL 162-167; MYRISTYL 249-254; PKC_PHOSPHO_SITE 54-56; MYRISTYL 99-104; | |
| DEX0455_012.orf.2 | N | 0 - o1-250; | 4-10, 1.07; 104-117, 1.102; 240-246, 1.107; 135-163, 1.153; 16-32, 1.09; 61-69, 1.129; 228-234, 1.037; 73-80, 1.131; 122-128, 1.067; 171-178, 1.08; 37-44, 1.077; 211-224, 1.099; | CK2_PHOSPHO_SITE 166-169; MYRISTYL 1-6; MYRISTYL 134-139; MYRISTYL 217-222; MYRISTYL 197-202; CK2_PHOSPHO_SITE 167-170; MYRISTYL 88-93; CK2_PHOSPHO_SITE 238-241; PKC_PHOSPHO_SITE 89-91; CK2_PHOSPHO_SITE 128-131; PKC_PHOSPHO_SITE 11-13; MYRISTYL 28-33; MYRISTYL 22-27; CK2_PHOSPHO_SITE 123-126; MYRISTYL 33-38; MYRISTYL 235-240; CK2_PHOSPHO_SITE 55-58; | SAM_PNT 83-167; SAM_PNT 83-167; |
| DEX0455_012.aa.2 | N | 0 - o1-402; | 176-189, 1.099; 38-45, 1.131; 288-294, 1.052; 26-34, 1.129; 69-82, 1.102; 205-218, 1.129; 100-128, 1.153; 136-143, 1.08; 311-318, 1.118; 4-9, 1.066; 87-93, 1.067; 379-385, 1.088; 193-199, 1.037; 332-346, 1.091; | AMIDATION 273-276; MYRISTYL 53-58; AMIDATION 377-380; CK2_PHOSPHO_SITE 246-249; MYRISTYL 99-104; CK2_PHOSPHO_SITE 224-227; MYRISTYL 162-167; CK2_PHOSPHO_SITE 203-206; PKC_PHOSPHO_SITE 54-56; ASN_GLYCOSYLATION 388-391; CK2_PHOSPHO_SITE 213-216; CK2_PHOSPHO_SITE 88-91; MYRISTYL 182-187; ASN_GLYCOSYLATION 354-357; AMIDATION 293-296; CK2_PHOSPHO_SITE 20-23; CAMP_PHOSPHO_SITE 282-285; CK2_PHOSPHO_SITE 93-96; CAMP_PHOSPHO_SITE 350-353; CK2_PHOSPHO_SITE 132-135; MYRISTYL 233-238; CK2_PHOSPHO_SITE 131-134; MYRISTYL 200-205; | ETSDOMAIN 330-348; ETSDOMAIN 349-367; ETSDOMAIN 304-317; SAM_PNT 48-132; AT_hook 275-287; ETS_DOMAIN_3 304-386; SAM_PNT 48-132; HSF_ETS 314-376; ETSDOMAIN 368-386; Ets 303-388; ETS 303-390; |
| DEX0455_013.aa.1 | N | 0 - o1-219; | 38-45, 1.105; 183-198, 1.162; 129-146, 1.173; 154-173, 1.144; 93-115, 1.187; 4-34, 1.161; 50-60, 1.202; | CK2_PHOSPHO_SITE 37-40; MYRISTYL 49-54; ASN_GLYCOSYLATION 46-49; MYRISTYL 30-35; CK2_PHOSPHO_SITE 173-176; MYRISTYL 147-152; PKC_PHOSPHO_SITE 200-202; MYRISTYL 100-105; PKC_PHOSPHO_SITE 214-216; | |
| DEX0455_013.aa.2 | N | 0 - o1-172; | 82-99 1.173; 4-10, 1.154; 46-68, 1.187; 136-151, 1.162; 107-126, 1.144; | CK2_PHOSPHO_SITE 126-129; MYRISTYL 100-105; MYRISTYL 53-58; PKC_PHOSPHO_SITE 167-169; PKC_PHOSPHO_SITE 153-155; | |
| DEX0455_014.orf.1 | N | 0 - o1-329; | 4-10, 1.104; 140-146, 1.062; 76-82, 1.057; 117-125, 1.126; | CK2_PHOSPHO_SITE 110-113; CK2_PHOSPHO_SITE 24-27; CAMP_PHOSPHO_SITE 198-201; PKC_PHOSPHO_SITE 95-97; PKC_PHOSPHO_SITE 308-310; CK2_PHOSPHO_SITE 156-159; AMIDATION 12-15; | EFh 204-232; EF_HAND_2_1 153-229; EF_HAND 213-225; Calpain_III 1-133; EF_HAND 243-255; efhand |

-continued

| DEX ID | Sig P | TMHMM | Antigenicity | PTM | Domains |
|---|---|---|---|---|---|
| | | | 181-192, 1.181; 300-307, 1.103; 162-169, 1.103; 314-320, 1.054; 52-65, 1.124; 197-212, 1.145; 235-242, 1.069; 32-40, 1.209; 96-113, 1.1; 224-230, 1.049; 18-24, 1.096; 255-278, 1.221; 290-298, 1.171; | CK2_PHOSPHO_SITE 177-180; PKC_PHOSPHO_SITE 204-206; MYRISTYL 29-34; CK2_PHOSPHO_SITE 210-213; PKC_PHOSPHO_SITE 126-128; CK2_PHOSPHO_SITE 150-153; CK2_PHOSPHO_SITE 251-254; PKC_PHOSPHO_SITE 24-26; ASN_GLYCOSYLATION 299-302; CK2_PHOSPHO_SITE 22-25; MYRISTYL 248-253; | 204-232; EFh 234-262; calpain_III 5-133; efhand 234-262; EF_HAND_2_2 237-294; |
| DEX0455_014.aa.1 | N | 0 - o1-595; | 21-44, 1.113; 556-564, 1.171; 49-73, 1.155; 75-82, 1.121; 179-185, 1.061; 284-290, 1.096; 342-348, 1.057; 117-125, 1.165; 103-110, 1.113; 566-573, 1.103; 259-275, 1.108; 428-435, 1.103; 188-197, 1.149; 86-98, 1.077; 318-331, 1.124; 447-458, 1.181; 132-143, 1.081; 4-11, 1.247; 362-379, 1.1; 209-229, 1.083; 490-496, 1.049; 298-306, 1.209; 521-544, 1.221; 580-586, 1.054; 463-478, 1.145; 501-508, 1.069; 383-391, 1.126; 406-412, 1.062; | CK2_PHOSPHO_SITE 153-156; ASN_GLYCOSYLATION 143-146; PKC_PHOSPHO_SITE 290-292; CK2_PHOSPHO_SITE 200-203; MYRISTYL 189-194; CK2_PHOSPHO_SITE 288-291; CK2_PHOSPHO_SITE 290-293; CK2_PHOSPHO_SITE 517-520; CK2_PHOSPHO_SITE 250-253; ASN_GLYCOSYLATION 17-20; MYRISTYL 295-300; PKC_PHOSPHO_SITE 392-394; ASN_GLYCOSYLATION 248-251; ASN_GLYCOSYLATION 565-568; PKC_PHOSPHO_SITE 252-254; MYRISTYL 211-216; CK2_PHOSPHO_SITE 221-224; CK2_PHOSPHO_SITE 422-425; CAMP_PHOSPHO_SITE 464-467; MYRISTYL 164-169; MYRISTYL 144-149; CK2_PHOSPHO_SITE 114-117; CK2_PHOSPHO_SITE 47-50; PKC_PHOSPHO_SITE 114-116; MYRISTYL 45-50; PKC_PHOSPHO_SITE 470-472; PKC_PHOSPHO_SITE 227-229; CK2_PHOSPHO_SITE 19-22; PKC_PHOSPHO_SITE 361-363; CK2_PHOSPHO_SITE 376-379; CK2_PHOSPHO_SITE 476-479; MYRISTYL 514-519; PKC_PHOSPHO_SITE 574-576; CK2_PHOSPHO_SITE 443-446; CK2_PHOSPHO_SITE 416-419; CAMP_PHOSPHO_SITE 187-190; TYR_PHOSPHO_SITE 172-179; | Calpain_III 261-399; THIOL_PROTEASE_CYS 53-64; EFh 470-498; CALPAIN 89-114; efhand 500-528; EF_HAND_2_1 419-495; Peptidase_C2 14-273; CYS_PROT_CALPAIN 32-273; CysPc 2-281; EF_HAND_2_2 503-560; CALPAIN 53-69; EFh 500-528; EF_HAND 509-521; CALPAIN 29-51; EF_HAND 479-491; calpain_III 241-399; CALPAIN 365-393; efhand 470-498; CALPAIN 119-142; |
| DEX0455_015.aa.1 | N | 0 - o1-85; | 63-82, 1.15; 20-26, 1.04; | CK2_PHOSPHO_SITE 42-45; PKC_PHOSPHO_SITE 35-37; CK2_PHOSPHO_SITE 81-84; | ER_TARGET 82-85; |

-continued

| DEX ID | Sig P | TMHMM | Antigenicity | PTM | Domains |
|---|---|---|---|---|---|
| | | | 4-14, 1.174; 35-46, 1.138; | CK2_PHOSPHO_SITE 19-22; PKC_PHOSPHO_SITE 68-70; | |
| DEX0455_016.aa.1 | N | 0 - o1-255; | 105-110, 1.047; 223-241, 1.155; 75-81, 1.064; 244-252, 1.167; 86-94, 1.048; 145-151, 1.048; 154-171, 1.113; 185-202, 1.095; 4-12, 1.094; 32-44, 1.04; 129-138, 1.113; | MYRISTYL 24-29; MYRISTYL 22-27; PKC_PHOSPHO_SITE 207-209; MYRISTYL 152-157; MYRISTYL 21-26; MYRISTYL 225-230; MYRISTYL 198-203; MYRISTYL 16-21; MYRISTYL 17-22; MYRISTYL 18-23; ASN_GLYCOSYLATION 82-85; MYRISTYL 13-18; MYRISTYL 20-25; MYRISTYL 46-51; MYRISTYL 26-31; MYRISTYL 19-24; MYRISTYL 50-55; PKC_PHOSPHO_SITE 159-161; | KH 189-240; GLY_RICH 13-26; KH 99-169; KH 184-239; KH_TYPE_1_1 100-164; KH 104-152; KH_TYPE_1_2 185-224; |
| DEX0455_017.aa.1 | N | 0 - o1-174; | 82-95, 1.136; 112-129, 1.149; 98-110, 1.124; 58-65, 1.171; 138-155, 1.209; 4-15, 1.221; 34-41, 1.125; | ASN_GLYCOSYLATION 29-32; MYRISTYL 104-109; PKC_PHOSPHO_SITE 166-168; ASN_GLYCOSYLATION 42-45; PKC_PHOSPHO_SITE 162-164; CK2_PHOSPHO_SITE 70-73; PKC_PHOSPHO_SITE 31-33; ASN_GLYCOSYLATION 72-75; MYRISTYL 105-110; CK2_PHOSPHO_SITE 44-47; MYRISTYL 34-39; MYRISTYL 112-117; ASN_GLYCOSYLATION 66-69; CK2_PHOSPHO_SITE 20-23; | TM4_2 16-124; |
| DEX0455_018.aa.1 | N | 0 - o1-354; | 152-174, 1.101; 232-240, 1.163; 67-74, 1.098; 289-311, 1.168; 57-63, 1.087; 33-44, 1.198; 207-225, 1.149; 276-282, 1.104; 22-28, 1.058; 117-150, 1.291; 243-265, 1.125; 319-338, 1.116; 182-199, 1.136; 344-350, 1.079; 49-55, 1.112; 76-110, 1.213; | MYRISTYL 174-179; CK2_PHOSPHO_SITE 62-65; PKC_PHOSPHO_SITE 334-336; PKC_PHOSPHO_SITE 348-350; CK2_PHOSPHO_SITE 11-14; MYRISTYL 319-324; PKC_PHOSPHO_SITE 46-48; CK2_PHOSPHO_SITE 228-231; MYRISTYL 19-24; MYRISTYL 18-23; TYR_PHOSPHO_SITE 63-70; | PROTEIN_KINASE_DOM 10-283; TYRKINASE 104-117; S_TK_X 284-348; sp_Q9UM03_Q9UM03_HUMAN 37-283; S_TKc 37—283; TyrKc 38-277; PROTEIN_KINASE_ST 145-157; TYRKINASE 139-157; TYRKINASE 205-227; pkinase_C 284-351; pkinase 31-283; |
| DEX0455_018.aa.2 | N | 0 - o1-489; | 356-363, 1.123; 215-226, 1.053; 151-169, 1.163; 175-195, 1.157; 378-390, 1.189; 103-122, 1.165; 50-59, 1.127; 258-276, 1.096; | CK2_PHOSPHO_SITE 135-138; PKC_PHOSPHO_SITE 60-62; PKC_PHOSPHO_SITE 434-436; PKC_PHOSPHO_SITE 206-208; MYRISTYL 442-447; PKC_PHOSPHO_SITE 45-47; CK2_PHOSPHO_SITE 307-310; PKC_PHOSPHO_SITE 453-455; LEUCINE_ZIPPER 50-71; PKC_PHOSPHO_SITE 205-207; CK2_PHOSPHO_SITE 164-167; LEUCINE_ZIPPER 222-243; ASN_GLYCOSYLATION 126-129; MYRISTYL 452-457; CK2_PHOSPHO_SITE 414-417; | HR1 105-181; HR1 182-255; HR1 18-90; HR1 18-90; REM_REPEAT_1 15-74; HR1 182-255; REM_REPEAT_2 107-166; HR1 105-181; REM_REPEAT_3 175-239; |

-continued

| DEX ID | Sig P | TMHMM | Antigenicity | PTM | Domains |
|---|---|---|---|---|---|
| | | | 228-252, 1.133; 129-134, 1.041; 393-422, 1.174; 440-457, 1.171; 459-483, 1.218; 327-343, 1.235; 139-147, 1.103; 278-307, 1.151; 88-94, 1.072; 65-83, 1.135; 198-206, 1.174; | MYRISTYL 407-412; PKC_PHOSPHO_SITE 226-228; PKC_PHOSPHO_SITE 135-137; LEUCINE_ZIPPER 215-236; | |
| DEX0455_019.aa.1 | Y | 0 - o1-287; | 209-234, 1.163; 268-274, 1.108; 249-254, 1.037; 171-180, 1.184; 65-73, 1.106; 189-197, 1.098; 8-21, 1.242; 91-102, 1.114; 54-60, 1.089; 129-136, 1.123; 33-40, 1.121; 236-244, 1.078; 109-127, 1.096; 140-154, 1.114; | MYRISTYL 82-87; AMIDATION 102-105; MYRISTYL 214-219; PKC_PHOSPHO_SITE 26-28; ASN_GLYCOSYLATION 243-246; ASN_GLYCOSYLATION 163-166; PKC_PHOSPHO_SITE 238-240; PKC_PHOSPHO_SITE 193-195; MYRISTYL 247-252; CK2_PHOSPHO_SITE 218-221; PKC_PHOSPHO_SITE 165-167; ASN_GLYCOSYLATION 203-206; CK2_PHOSPHO_SITE 48-51; PKC_PHOSPHO_SITE 248-250; | Folate_rec 7-287; |
| DEX0455_020.aa.1 | N | 0 - o1-143; | 73-79, 1.044; 101-120, 1.206; 129-140, 1.111; 27-32, 1.039; 83-93, 1.128; 4-18, 1.179; 46-67, 1.134; | AMIDATION 25-28; CK2_PHOSPHO_SITE 99-102; MYRISTYL 126-131; MYRISTYL 79-84; PKC_PHOSPHO_SITE 71-73; MYRISTYL 119-124; MYRISTYL 75-80; PKC_PHOSPHO_SITE 72-74; ASN_GLYCOSYLATION 97-100; PKC_PHOSPHO_SITE 136-138; MYRISTYL 68-73; | |
| DEX0455_020.orf.2 | N | 0 - o1-116; | 32-64, 1.153; 84-90, 1.128; 96-102, 1.085; 13-21, 1.109; | MYRISTYL 106-111; CK2_PHOSPHO_SITE 34-37; PKC_PHOSPHO_SITE 12-14; MYRISTYL 6-11; MYRISTYL 29-34; MYRISTYL 68-73; AMIDATION 61-64; PKC_PHOSPHO_SITE 78-80; MYRISTYL 92-97; CK2_PHOSPHO_SITE 25-28; | |
| DEX0455_020.aa.2 | N | 0 - o1-67; | 29-46, 1.092; 52-64, 1.187; 11-21, 1.128; | CK2_PHOSPHO_SITE 44-47; ASN_GLYCOSYLATION 25-28; MYRISTYL 7-12; | |
| DEX0455_021.orf.1 | N | 0 - o1-104; | 86-97, 1.124; 4-9, 1.11; 35-71, 1.171; 14-22, 1.095; | PKC_PHOSPHO_SITE 81-83; PKC_PHOSPHO_SITE 100-102; CAMP_PHOSPHO_SITE 33-36; PKC_PHOSPHO_SITE 32-34; MYRISTYL 10-15; | |

-continued

| DEX ID | Sig P | TMHMM | Antigenicity | PTM | Domains |
|---|---|---|---|---|---|
| DEX0455_021.aa.1 | N | 0 - o1-82; | 45-51, 1.09; 4-11, 1.131; 15-23, 1.096; | | |
| DEX0455_021.aa.2 | N | 0 - o1-360; | 112-119, 1.083; 209-218, 1.167; 121-147, 1.118; 179-186, 1.153; 73-108, 1.131; 290-300, 1.12; 169-175, 1.09; 46-55, 1.071; 309-318, 1.162; 4-10, 1.11; 341-347, 1.071; 13-34, 1.181; 193-199, 1.098; 239-267, 1.186; | ASN_GLYCOSYLATION 108-111; MYRISTYL 203-208; AMIDATION 217-220; CK2_PHOSPHO_SITE 44-47; AMIDATION 325-328; PKC_PHOSPHO_SITE 48-50; CK2_PHOSPHO_SITE 18-21; CAMP_PHOSPHO_SITE 78-81; PKC_PHOSPHO_SITE 56-58; MYRISTYL 263-268; MYRISTYL 190-195; | Epimerase 5-311; galE 4-296; |
| DEX0455_021.orf.3 | N | 0 - o1-376; | 24-47, 1.119; 241-247, 1.098; 94-103, 1.071; 61-82, 1.181; 357-366, 1.162; 51-58, 1.11; 257-266, 1.167; 169-195, 1.118; 121-156, 1.131; 160-167, 1.083; 287-315, 1.186; 338-348, 1.12; 217-223, 1.09; 227-234, 1.153; | CK2_PHOSPHO_SITE 92-95; MYRISTYL 4-9; PKC_PHOSPHO_SITE 96-98; MYRISTYL 8-13; PKC_PHOSPHO_SITE 104-106; CAMP_PHOSPHO_SITE 126-129; MYRISTYL 238-243; CK2_PHOSPHO_SITE 66-69; MYRISTYL 9-14; AMIDATION 373-376; MYRISTYL 6-11; MYRISTYL 10-15; ASN_GLYCOSYLATION 156-159; AMIDATION 265-268; MYRISTYL 311-316; MYRISTYL 251-256; | galE 52-344; Epimerase 53-359; |
| DEX0455_021.aa.3 | N | 0 - o1-466; | 290-300, 1.12; 239-267, 1.186; 209-218, 1.167; 399-417, 1.182; 193-199, 1.098; 4-10, 1.11; 121-147, 1.118; 46-55, 1.071; 112-119, 1.083; 337-393, 1.213; 13-34, 1.181; 309-318, 1.162; 73-108, 1.131; 169-175, 1.09; 422-434, 1.145; | PKC_PHOSPHO_SITE 48-50; MYRISTYL 203-208; AMIDATION 217-220; PKC_PHOSPHO_SITE 56-58; MYRISTYL 263-268; AMIDATION 325-328; PKC_PHOSPHO_SITE 399-401; PKC_PHOSPHO_SITE 372-374; MYRISTYL 359-364; MYRISTYL 190-195; ASN_GLYCOSYLATION 108-111; PKC_PHOSPHO_SITE 346-348; CK2_PHOSPHO_SITE 44-47; CAMP_PHOSPHO_SITE 78-81; CK2_PHOSPHO_SITE 18-21; | galE 4-462; Epimerase 5-459; |

-continued

| DEX ID | Sig P | TMHMM | Antigenicity | PTM | Domains |
|---|---|---|---|---|---|
| DEX0455_021.aa.4 | N | 0 - o1-328; | 179-186, 1.153; 112-119, 1.083; 239-267, 1.186; 193-199, 1.098; 169-175, 1.09; 309-318, 1.162; 73-108, 1.131; 209-218, 1.167; 290-300, 1.12; 121-147, 1.118; 13-34, 1.181; 46-55, 1.071; 179-186, 1.153; 4-10, 1.11; | MYRISTYL 190-195; MYRISTYL 263-268; PKC_PHOSPHO_SITE 56-58; CK2_PHOSPHO_SITE 44-47; MYRISTYL 203-208; CK2_PHOSPHO_SITE 18-21; AMIDATION 217-220; ASN_GLYCOSYLATION 108-111; PKC_PHOSPHO_SITE 48-50; AMIDATION 325-328; CAMP_PHOSPHO_SITE 78-81; | galE 4-296; Epimerase 5-311; |
| DEX0455_022.aa.1 | Y | 1 - i1-21; tm22-44; o45-178; | 54-73, 1.132; 19-46, 1.26; 123-135, 1.041; 5-12, 1.131; 81-101, 1.08; 140-149, 1.16; 151-157, 1.051; 161-171, 1.056; | PKC_PHOSPHO_SITE 145-147; TYR_PHOSPHO_SITE 147-154; AMIDATION 173-176; CK2_PHOSPHO_SITE 4-7; ASN_GLYCOSYLATION 65-68; ASN_GLYCOSYLATION 92-95; PKC_PHOSPHO_SITE 45-47; CK2_PHOSPHO_SITE 156-159; | |
| DEX0455_022.orf.2 | Y | 1 - o1-34; tm35-57; i58-141; | 32-59, 1.26; 67-86, 1.132; 4-9, 1.102; 126-138, 1.071; 18-25, 1.131; 94-114, 1.08; | ASN_GLYCOSYLATION 78-81; PKC_PHOSPHO_SITE 58-60; PKC_PHOSPHO_SITE 7-9; CK2_PHOSPHO_SITE 17-20; ASN_GLYCOSYLATION 105-108; | |
| DEX0455_022.aa.2 | Y | 1 - i1-21; tm22-44; o45-188; | 113-128, 1.071; 131-144, 1.136; 148-157, 1.16; 19-46, 1.26; 81-101, 1.08; 5-12, 1.131; 169-185, 1.221; 159-165, 1.051; 54-73, 1.132; | ASN_GLYCOSYLATION 92-95; ASN_GLYCOSYLATION 65-68; TYR_PHOSPHO_SITE 155-162; PKC_PHOSPHO_SITE 153-155; CK2_PHOSPHO_SITE 4-7; PKC_PHOSPHO_SITE 45-47; CK2_PHOSPHO_SITE 164-167; | |
| DEX0455_022.aa.3 | Y | 0 - o1-78; | 6-14, 1.07; 48-65, 1.202; 70-75, 1.085; | MYRISTYL 48-53; MYRISTYL 34-39; MYRISTYL 14-19; MYRISTYL 27-32; MYRISTYL 6-11; PKC_PHOSPHO_SITE 68-70; MYRISTYL 39-44; MYRISTYL 13-18; MYRISTYL 20-25; | GLY_RICH 5-48; |
| DEX0455_023.aa.1 | N | 0 - o1-116; | 69-80, 1.147; 50-61, 1.08; 27-37, 1.085; 82-89, 1.049; 4-13, 1.11; | PKC_PHOSPHO_SITE 57-59; CAMP_PHOSPHO_SITE 48-51; PKC_PHOSPHO_SITE 52-54; PKC_PHOSPHO_SITE 47-49; PKC_PHOSPHO_SITE 101-103; PKC_PHOSPHO_SITE 43-45; CK2_PHOSPHO_SITE 36-39; AMIDATION 39-42; PKC_PHOSPHO_SITE 97-99; CAMP_PHOSPHO_SITE 54-57; | |

-continued

| DEX ID | Sig P | TMHMM | Antigenicity | PTM | Domains |
|---|---|---|---|---|---|
| DEX0455_024.aa.1 | N | 0 - o1-360; | 245-252, 1.15; 127-136, 1.145; 208-215, 1.12; 309-317, 1.126; 117-124, 1.107; 274-284, 1.206; 189-197, 1.193; 348-357, 1.265; 324-340, 1.091; 147-157, 1.162; 78-85, 1.168; 232-240, 1.187; 167-172, 1.042; 289-295, 1.073; 61-70, 1.189; | PKC_PHOSPHO_SITE 34-36; PKC_PHOSPHO_SITE 257-259; PKC_PHOSPHO_SITE 33-35; PKC_PHOSPHO_SITE 298-300; MYRISTYL 6-11; MYRISTYL 144-149; CK2_PHOSPHO_SITE 176-179; ASN_GLYCOSYLATION 286-289; PKC_PHOSPHO_SITE 22-24; CAMP_PHOSPHO_SITE 254-257; MYRISTYL 29-34; PKC_PHOSPHO_SITE 7-9; CK2_PHOSPHO_SITE 344-347; CK2_PHOSPHO_SITE 315-318; CK2_PHOSPHO_SITE 272-275; CAMP_PHOSPHO_SITE 163-166; CK2_PHOSPHO_SITE 71-74; MYRISTYL 303-308; CK2_PHOSPHO_SITE 158-161; PKC_PHOSPHO_SITE 264-266; CK2_PHOSPHO_SITE 73-76; CK2_PHOSPHO_SITE 257-260; | ANNEXINI 343-356; sp_P09525_ANX4_HUMAN 131-196; ANNEXINV 219-245; annexin 212-280; ANNEXINV 343-356; ANNEXINV 136-157; annexin 288-355; ANNEXIN 109-125; sp_P08132_ANX4_PIG 214-283; ANNEXIN 136-157; sp_Q9NFS4_Q9NFS4_GIALA 89-348; ANNEXIN 219-245; ANNEXINV 299-325; ANNEXIN 72-124; ANNEXINI 299-319; ANNEXINI 219-245; annexin 16-124; ANNEXIN 228-280; ANNEXINI 136-157; annexin 129-196; ANX 303-355; ANNEXINV 69-91; ANX 144-196; ANNEXINI 69-91; ANNEXINI 109-125; ANNEXIN 69-91; sp_P09525_ANX4_HUMAN 290-358; ANX 228-280; ANNEXINV 109-125; ANX 72-124; ANNEXIN 303-355; ANNEXINI 109-125; ANNEXINI 136-157; ANNEXINI 69-91; ANNEXINI 343-356; ANNEXIN 144-196; ANNEXINI 299-319; sp_P09525_ANX4_HUMAN 63-127; ANNEXIN 299-319; ANNEXINI 219-245; ANNEXIN 343-356; |
| DEX0455_024.aa.2 | N | 0 - o1-177; | 4-14, 1.157; 165-174, 1.265; 141-157, 1.091; 91-101, 1.206; 126-134, 1.126; 49-57, 1.187; 25-32, 1.12; 106-112, 1.073; 62-69, 1.15; | CK2_PHOSPHO_SITE 132-135; CK2_PHOSPHO_SITE 161-164; ASN_GLYCOSYLATION 103-106; MYRISTYL 120-125; CK2_PHOSPHO_SITE 89-92; CAMP_PHOSPHO_SITE 71-74; PKC_PHOSPHO_SITE 115-117; PKC_PHOSPHO_SITE 81-83; PKC_PHOSPHO_SITE 74-76; CK2_PHOSPHO_SITE 74-77; | ANNEXINIV 36-62; sp_P08132_ANX4_PIG 31-100; ANNEXINII 36-62; sp_P09525_ANX4_HUMAN 107-175; ANNEXINII 160-173; ANNEXINII 116-136; ANNEXIN 160-173; ANNEXINIV 160-173; annexin 29-97; ANNEXIN 120-172; ANX 45-97; ANNEXIN 36-62; ANX 120-172; |

-continued

| DEX ID | Sig P | TMHMM | Antigenicity | PTM | Domains |
|---|---|---|---|---|---|
| | | | | | ANNEXIN 45-97; ANNEXINIV 116-142; ANNEXIN 116-136; annexin 105-172; |
| DEX0455_025.aa.1 | N | 0 - o1-380; | 55-61, 1.085; 95-102, 1.121; 124-165, 1.203; 253-265, 1.112; 280-315, 1.154; 201-211, 1.092; 323-341, 1.121; 25-49, 1.169; 350-357, 1.074; 362-370, 1.179; 9-15, 1.13; 269-278, 1.061; 73-90, 1.133; 175-185, 1.225; 243-250, 1.061; 111-121, 1.127; | PKC_PHOSPHO_SITE 296-298; CK2_PHOSPHO_SITE 230-233; MYRISTYL 357-362; CK2_PHOSPHO_SITE 118-121; TYR_PHOSPHO_SITE 298-305; ASN_GLYCOSYLATION 51-54; PKC_PHOSPHO_SITE 358-360; CK2_PHOSPHO_SITE 318-321; ASN_GLYCOSYLATION 344-347; MYRISTYL 55-60; PKC_PHOSPHO_SITE 349-351; MYRISTYL 224-229; CK2_PHOSPHO_SITE 169-172; PKC_PHOSPHO_SITE 71-73; CK2_PHOSPHO_SITE 352-355; CK2_PHOSPHO_SITE 308-311; CK2_PHOSPHO_SITE 228-231; PKC_PHOSPHO_SITE 68-70; | |
| DEX0455_025.orf.2 | Y | 0 - o1-394; | 329-364, 1.154; 318-327, 1.061; 18-31, 1.139; 4-15, 1.18; 104-110, 1.085; 122-139, 1.133; 302-314, 1.112; 250-260, 1.092; 74-98, 1.169; 372-391, 1.121; 292-299, 1.061; 173-214, 1.203; 36-43, 1.073; 160-170, 1.127; 144-151, 1.121; 224-234, 1.225; 58-64, 1.13; | PKC_PHOSPHO_SITE 45-47; CK2_PHOSPHO_SITE 35-38; TYR_PHOSPHO_SITE 347-354; MYRISTYL 104-109; PKC_PHOSPHO_SITE 117-119; PKC_PHOSPHO_SITE 120-122; CK2_PHOSPHO_SITE 357-360; CK2_PHOSPHO_SITE 218-221; PKC_PHOSPHO_SITE 15-17; CK2_PHOSPHO_SITE 279-282; MYRISTYL 273-278; CK2_PHOSPHO_SITE 277-280; ASN_GLYCOSYLATION 100-103; CK2_PHOSPHO_SITE 15-18; PKC_PHOSPHO_SITE 345-347; CK2_PHOSPHO_SITE 367-370; CK2_PHOSPHO_SITE 167-170; | |
| DEX0455_025.aa.2 | N | 0 - o1-679; | 95-102, 1.121; 557-564, 1.066; 111-121, 1.127; 9-15, 1.13; 655-665, 1.082; 243-250, 1.061; 73-90, 1.133; 507-513, 1.056; 124-165, 1.203; | PKC_PHOSPHO_SITE 652-654; PKC_PHOSPHO_SITE 296-298; TYR_PHOSPHO_SITE 298-305; MYRISTYL 224-229; PKC_PHOSPHO_SITE 632-634; CK2_PHOSPHO_SITE 653-656; CK2_PHOSPHO_SITE 228-231; MYRISTYL 349-354; CK2_PHOSPHO_SITE 230-233; MYRISTYL 507-512; MYRISTYL 361-366; PKC_PHOSPHO_SITE 588-590; CK2_PHOSPHO_SITE 640-643; PKC_PHOSPHO_SITE 526-528; MYRISTYL 55-60; PKC_PHOSPHO_SITE 555-557; CK2_PHOSPHO_SITE 118-121; | |

-continued

| DEX ID | Sig P | TMHMM | Antigenicity | PTM | Domains |
|---|---|---|---|---|---|
| | | | 539-548, 1.107; 623-630, 1.089; 253-265, 1.112; 360-365, 1.048; 280-315, 1.154; 386-392, 1.069; 394-416, 1.152; 489-499, 1.139; 269-278, 1.061; 368-384, 1.143; 578-589, 1.155; 175-185, 1.225; 473-482, 1.179; 201-211, 1.092; 323-355, 1.122; 25-49, 1.169; 424-465, 1.143; 55-61, 1.085; 633-639, 1.052; 601-618, 1.106; 521-528, 1.118; | PKC_PHOSPHO_SITE 71-73; LEUCINE_ZIPPER 453-474; PKC_PHOSPHO_SITE 631-633; PKC_PHOSPHO_SITE 68-70; CK2_PHOSPHO_SITE 540-543; PKC_PHOSPHO_SITE 513-515; ASN_GLYCOSYLATION 51-54; MYRISTYL 674-679; CK2_PHOSPHO_SITE 318-321; CK2_PHOSPHO_SITE 308-311; CK2_PHOSPHO_SITE 169-172; | |
| DEX0455_026.orf.1 | N | 0 - i1-72; | | ASN_GLYCOSYLATION 46-49; CK2_PHOSPHO_SITE 62-65; | |
| DEX0455_026.aa.1 | N | 0 - i1-77; | 69-74, 1.113; 47-54, 1.103; 7-34, 1.196; | CK2_PHOSPHO_SITE 58-61; CK2_PHOSPHO_SITE 53-56; | |
| DEX0455_027.orf.1 | N | 0 - o1-174; | 54-76, 1.16; 118-139, 1.134; 40-52, 1.162; 4-20, 1.164; 155-171, 1.137; 103-113, 1.167; | CK2_PHOSPHO_SITE 65-68; MYRISTYL 53-58; MYRISTYL 40-45; PKC_PHOSPHO_SITE 75-77; ASN_GLYCOSYLATION 93-96; CK2_PHOSPHO_SITE 171-174; CK2_PHOSPHO_SITE 114-117; CK2_PHOSPHO_SITE 83-86; MYRISTYL 152-157; | |
| DEX0455_027.aa.1 | N | 0 - i1-36; | 5-28, 1.145; | | |
| DEX0455_028.aa.1 | N | 0 - o1-215; | | MYRISTYL 144-149; CK2_PHOSPHO_SITE 30-33; PKC_PHOSPHO_SITE 111-113; PKC_PHOSPHO_SITE 68-70; CK2_PHOSPHO_SITE 111-114; MYRISTYL 52-57; CK2_PHOSPHO_SITE 167-170; CK2_PHOSPHO_SITE 28-31; GLYCOSAMINOGLYCAN 36-39; MYRISTYL 106-111; CK2_PHOSPHO_SITE 7-10; PKC_PHOSPHO_SITE 210-212; CK2_PHOSPHO_SITE 82-85; | cobW 41-214; ATP_GTP_A 49-56; |
| DEX0455_029.orf.1 | Y | 0 - o1-133; | 109-124, 1.141; 4-18, 1.154; 26-79, 1.144; | CK2_PHOSPHO_SITE 120-123; | |

-continued

| DEX ID | Sig P | TMHMM | Antigenicity | PTM | Domains |
|---|---|---|---|---|---|
| DEX0455_029.aa.1 | N | 5 - i1-20; tm21-43; o44-55; tm56-78; i79-188; tm189-211; o212-265; tm266-288; i289-294; tm295-317; o318-953; | 589-601, 1.168; 141-213, 1.251; 4-19, 1.116; 84-92, 1.108; 810-816, 1.062; 787-805, 1.18; 292-319, 1.22; 818-881, 1.176; 914-920, 1.094; 121-132, 1.185; 721-739, 1.162; 531-544, 1.196; 655-680, 1.23; 52-80, 1.244; 348-380, 1.166; 388-401, 1.1; 700-708, 1.061; 609-619, 1.166; 753-782, 1.251; 321-340, 1.148; 551-568, 1.095; 884-898, 1.185; 570-587, 1.245; 924-935, 1.123; 691-697, 1.081; 255-286, 1.151; 409-462, 1.144; 99-116, 1.162; 492-507, 1.141; 21-46, 1.201; 243-252, 1.116; 512-524, 1.154; 624-652, 1.188; | CK2_PHOSPHO_SITE 503-506; PKC_PHOSPHO_SITE 546-548; CK2_PHOSPHO_SITE 714-717; ASN_GLYCOSYLATION 747-750; MYRISTYL 695-700; PKC_PHOSPHO_SITE 716-718; ASN_GLYCOSYLATION 51-54; MYRISTYL 651-656; PKC_PHOSPHO_SITE 351-353; ASN_GLYCOSYLATION 228-231; CK2_PHOSPHO_SITE 697-700; PKC_PHOSPHO_SITE 808-810; ASN_GLYCOSYLATION 782-785; CK2_PHOSPHO_SITE 904-907; PKC_PHOSPHO_SITE 622-624; PKC_PHOSPHO_SITE 904-906; TYR_PHOSPHO_SITE 297-303; PKC_PHOSPHO_SITE 755-757; PKC_PHOSPHO_SITE 784-786; PKC_PHOSPHO_SITE 317-319; PKC_PHOSPHO_SITE 2-4; PKC_PHOSPHO_SITE 879-881; CK2_PHOSPHO_SITE 546-549; PKC_PHOSPHO_SITE 332-334; PKC_PHOSPHO_SITE 835-837; MYRISTYL 130-135; CK2_PHOSPHO_SITE 936-939; PKC_PHOSPHO_SITE 139-141; CK2_PHOSPHO_SITE 934-937; ASN_GLYCOSYLATION 741-744; PKC_PHOSPHO_SITE 259-261; PKC_PHOSPHO_SITE 938-940; CK2_PHOSPHO_SITE 879-882; PKC_PHOSPHO_SITE 230-232; PKC_PHOSPHO_SITE 912-914; MYRISTYL 240-245; PKC_PHOSPHO_SITE 909-911; PKC_PHOSPHO_SITE 161-163; | |
| DEX0455_029.orf.2 | Y | 0 - o1-194; | 26-79, 1.144; 165-176, 1.123; 125-139, 1.185; 109-122, 1.122; 4-18, 1.154; 155-161, 1.094; | CK2_PHOSPHO_SITE 145-148; PKC_PHOSPHO_SITE 153-155; PKC_PHOSPHO_SITE 145-147; PKC_PHOSPHO_SITE 120-122; PKC_PHOSPHO_SITE 179-181; CK2_PHOSPHO_SITE 177-180; PKC_PHOSPHO_SITE 150-152; CK2_PHOSPHO_SITE 120-123; CK2_PHOSPHO_SITE 175-178; | cobW 1-176; |
| DEX0455_029.aa.2 | N | 6 - o1-129; tm130-149; i150-168; tm169-191; o192-205; tm206-228; | 499-531, 1.166; 154-160, 1.051; 9-27, 1.196; 689-695, 1.094; 94-120, | PKC_PHOSPHO_SITE 312-314; TYR_PHOSPHO_SITE 448-454; PKC_PHOSPHO_SITE 290-292; PKC_PHOSPHO_SITE 381-383; PKC_PHOSPHO_SITE 410-412; CK2_PHOSPHO_SITE 32-35; CK2_PHOSPHO_SITE 709-712; | cobW 458-710; |

| DEX ID | Sig P | TMHMM | Antigenicity | PTM | Domains |
|---|---|---|---|---|---|
| | | i229-339; tm340-362; o363-416; tm417-439; i440-445; tm446-468; o469-728; | 1.182; 560-613, 1.144; 250-283, 1.185; 406-437, 1.151; 472-491, 1.148; 699-710, 1.123; 172-197, 1.201; 162-170, 1.116; 292-364, 1.251; 538-552, 1.1; 659-673, 1.185; 394-403, 1.116; 38-69, 1.174; 443-470, 1.22; 126-152, 1.243; 74-83, 1.196; 643-656, 1.122; 203-243, 1.244; | PKC_PHOSPHO_SITE 654-656; CK2_PHOSPHO_SITE 654-657; ASN_GLYCOSYLATION 379-382; ASN_GLYCOSYLATION 202-205; PKC_PHOSPHO_SITE 4-6; CK2_PHOSPHO_SITE 113-116; MYRISTYL 391-396; PKC_PHOSPHO_SITE 153-155; PKC_PHOSPHO_SITE 713-715; PKC_PHOSPHO_SITE 687-689; PKC_PHOSPHO_SITE 684-686; CK2_PHOSPHO_SITE 711-714; PKC_PHOSPHO_SITE 468-470; PKC_PHOSPHO_SITE 90-92; ASN_GLYCOSYLATION 120-123; PKC_PHOSPHO_SITE 502-504; MYRISTYL 281-286; CK2_PHOSPHO_SITE 679-682; PKC_PHOSPHO_SITE 483-485; PKC_PHOSPHO_SITE 679-681; | |
| DEX0455_030.aa.1 | N | 0 - o1-312; | 250-278, 1.145; 42-55, 1.148; 185-198, 1.08; 22-40, 1.148; 213-225, 1.123; 57-71, 1.09; 120-175, 1.145; 10-20, 1.094; 299-309, 1.17; 232-243, 1.157; 280-289, 1.066; 85-105, 1.201; | CK2_PHOSPHO_SITE 5-8; MYRISTYL 267-272; PKC_PHOSPHO_SITE 209-211; ASN_GLYCOSYLATION 250-253; CK2_PHOSPHO_SITE 198-201; MYRISTYL 166-171; MYRISTYL 113-118; TYR_PHOSPHO_SITE 141-149; | Metallophos 47-242; STPHPHTASE 48-75; STPHPHTASE 145-171; STPHPHTASE 230-250; STPHPHTASE 252-268; STPHPHTASE 77-104; PP2Ac 20-290; STPHPHTASE 174-201; PHOSPHO_ESTER 47-245; STPHPHTASE 110-134; sp_P33172_PPP4_HUMAN 7-290; SER_THR_PHOSPHATASE 111-116; |
| DEX0455_030.aa.2 | N | 0 - o1-182; | 108-118, 1.128; 4-12, 1.114; 47-67, 1.252; 71-81, 1.118; 38-44, 1.1; 149-160, 1.157; 91-97, 1.075; 167-179, 1.128; 18-36, 1.164; 130-142, 1.123; | PKC_PHOSPHO_SITE 126-128; PKC_PHOSPHO_SITE 95-97; CK2_PHOSPHO_SITE 53-56; CK2_PHOSPHO_SITE 116-119; MYRISTYL 83-88; ASN_GLYCOSYLATION 167-170; | STPHPHTASE 169-182; sp_P11084_PPP4_RABIT 104-182; STPHPHTASE 147-167; PP2Ac 33-182; |
| DEX0455_031.orf.1 | Y | 0 - o1-293; | 161-189, 1.17; 150-156, 1.092; 285-190, 1.091; 12-45, 1.129; 89-124, 1.191; 249-255, 1.087; 203-211, 1.196; | ASN_GLYCOSYLATION 78-81; MYRISTYL 103-108; CK2_PHOSPHO_SITE 80-83; MYRISTYL 233-238; PKC_PHOSPHO_SITE 220-222; MYRISTYL 167-172; MYRISTYL 201-206; CK2_PHOSPHO_SITE 178-181; PKC_PHOSPHO_SITE 10-12; MYRISTYL 281-286; MYRISTYL 61-66; AMIDATION 16-19; PKC_PHOSPHO_SITE 247-249; PKC_PHOSPHO_SITE | TNFR_NGFR_1 121-164; TNFR_c6 81-118; TNFR_NGFR_2_2 120-162; CYS_RICH 96-186; TNFR 81-118; TNFR_c6 208-248; TNFR_NGFR_2_3 207-248; TNFR_NGFR_1 81-118; |

-continued

| DEX ID | Sig P | TMHMM | Antigenicity | PTM | Domains |
|---|---|---|---|---|---|
| | | | 231-238, 1.08; 47-74, 1.166; 262-279, 1.144; 220-227, 1.113; 132-148, 1.205; | 156-158; CK2_PHOSPHO_SITE 125-128; CAMP_PHOSPHO_SITE 157-160; PKC_PHOSPHO_SITE 80-82; PKC_PHOSPHO_SITE 107-109; PKC_PHOSPHO_SITE 155-157; CK2_PHOSPHO_SITE 120-123; MYRISTYL 240-245; CAMP_PHOSPHO_SITE 18-21; TYR_PHOSPHO_SITE 82-89; CK2_PHOSPHO_SITE 227-230; CK2_PHOSPHO_SITE 190-193; ASN_GLYCOSYLATION 215-218; | TNFR 121-162; TNFR 164-205; TNFR_c6 121-162; TNFR 208-248; TNFR_c6 164-194; TNFR_NGFR_2_1 80-118; |
| DEX0455_031.aa.1 | Y | 1-o1-425; tm426-448; i449-635; | 193-200, 1.08; 51-86, 1.191; 165-173, 1.196; 614-621, 1.063; 182-189, 1.113; 427-464, 1.216; 112-118, 1.092; 268-294, 1.175; 211-217, 1.087; 344-423, 1.224; 296-325, 1.193; 247-265, 1.134; 472-477, 1.034; 482-528, 1.182; 596-602, 1.04; 224-241, 1.144; 123-151, 1.17; 575-589, 1.06; 538-543, 1.067; 9-36, 1.166; 560-572, 1.094; 94-110, 1.205; | MYRISTYL 23-28; PKC_PHOSPHO_SITE 182-184; PKC_PHOSPHO_SITE 331-333; TYR_PHOSPHO_SITE 44-51; ASN_GLYCOSYLATION 177-180; CK2_PHOSPHO_SITE 523-526; MYRISTYL 547-552; PKC_PHOSPHO_SITE 209-211; MYRISTYL 65-70; MYRISTYL 552-557; PKC_PHOSPHO_SITE 118-120; AMIDATION 382-385; MYRISTYL 195-200; CK2_PHOSPHO_SITE 87-90; PKC_PHOSPHO_SITE 623-625; MYRISTYL 202-207; MYRISTYL 411-416; MYRISTYL 376-381; MYRISTYL 286-291; CAMP_PHOSPHO_SITE 119-122; MYRISTYL 396-401; CK2_PHOSPHO_SITE 140-143; ASN_GLYCOSYLATION 40-43; CK2_PHOSPHO_SITE 42-45; PKC_PHOSPHO_SITE 321-323; MYRISTYL 243-248; CK2_PHOSPHO_SITE 152-155; PKC_PHOSPHO_SITE 42-44; CK2_PHOSPHO_SITE 82-85; MYRISTYL 163-168; MYRISTYL 619-624; MYRISTYL 129-134; PKC_PHOSPHO_SITE 117-119; CK2_PHOSPHO_SITE 189-192; PKC_PHOSPHO_SITE 69-71; | TNFR_NGFR_1 43-80; TNFR_NGFR_2_3 169-210; TNFR_c6 43-80; CYS_RICH 58-148; PRO_RICH 567-602; TNFR_NGFR_2_2 82-124; TNFR_NGFR_1 83-126; TNFR 43-80; TNFR_NGFR_2_1 42-80; TNFR 83-124; TNFR_c6 83-124; TNFR 126-167; TNFR_c6 170-210; TNFR 170-210; TNFR_c6 126-156; |
| DEX0455_031.aa.2 | Y | 0-o1-166; | 112-118, 1.092; 123-151, 1.17; 51-86, 1.191; 94-110, 1.205; 9-36, 1.166; | PKC_PHOSPHO_SITE 161-163; MYRISTYL 65-70; PKC_PHOSPHO_SITE 117-119; CK2_PHOSPHO_SITE 87-90; MYRISTYL 129-134; CK2_PHOSPHO_SITE 42-45; CK2_PHOSPHO_SITE 82-85; PKC_PHOSPHO_SITE 42-44; ASN_GLYCOSYLATION 40-43; PKC_PHOSPHO_SITE 69-71; CK2_PHOSPHO_SITE 140-143; PKC_PHOSPHO_SITE 118-120; MYRISTYL 23-28; CAMP_PHOSPHO_SITE 119-122; TYR_PHOSPHO_SITE 44-51; CK2_PHOSPHO_SITE 152-155; | TNFR_c6 43-80; TNFR 43-80; TNFR_NGFR_2_1 42-80; TNFR_NGFR_2_2 82-124; TNFR 83-124; TNFR 126-160; TNFR_NGFR_1 43-80; TNFR_NGFR_1 83-126; TNFR_c6 126-156; TNFR_c6 83-124; CYS_RICH 58-148; |
| DEX0455_031.orf.2 | N | 1-o1-95; tm96-118; i119-305; | 266-272, 1.04; 81-87, 1.087; 11-29, 1.128; 284-291, 1.063; 97-134, 1.216; 208-213, 1.067; 35-43, 1.196; | PKC_PHOSPHO_SITE 293-295; PKC_PHOSPHO_SITE 5-7; MYRISTYL 72-77; MYRISTYL 65-70; PKC_PHOSPHO_SITE 52-54; MYRISTYL 33-38; MYRISTYL 217-222; PKC_PHOSPHO_SITE 79-81; ASN_GLYCOSYLATION 47-50; MYRISTYL 289-294; CK2_PHOSPHO_SITE 59-62; CK2_PHOSPHO_SITE 193-196; | TNFR_NGFR_2 39-80; PRO_RICH 237-272; TNFR 40-80; |

-continued

| DEX ID | Sig P | TMHMM | Antigenicity | PTM | Domains |
|---|---|---|---|---|---|
| | | | 152-198, 1.182; 245-259, 1.06; 63-70, 1.08; 52-59, 1.113; 230-242, 1.094; 142-147, 1.034; | MYRISTYL 222-227; MYRISTYL 1-6; | |
| DEX0455_031.aa.3 | Y | 0 - o1-194; | 13-25, 1.182; 31-36, 1.034; 41-87, 1.182; 155-161, 1.04; 119-131, 1.094; 97-102, 1.067; 134-148, 1.06; 173-180, 1.063; | MYRISTYL 178-183; MYRISTYL 106-111; MYRISTYL 111-116; PKC_PHOSPHO_SITE 182-184; CAMP_PHOSPHO_SITE 9-12; CK2_PHOSPHO_SITE 82-85; | PRO_RICH 126-161; |
| DEX0455_032.aa.1 | N | 0 - o1-241; | 42-50, 1.149; 84-96, 1.1; 216-238, 1.152; 172-179, 1.085; 22-32, 1.209; 130-141, 1.11; 144-168, 1.133; 198-204, 1.108; 69-78, 1.125; | PKC_PHOSPHO_SITE 152-154; PKC_PHOSPHO_SITE 168-170; ASN_GLYCOSYLATION 39-42; CK2_PHOSPHO_SITE 206-209; CK2_PHOSPHO_SITE 204-207; PKC_PHOSPHO_SITE 112-114; ASN_GLYCOSYLATION 142-145; CK2_PHOSPHO_SITE 59-62; CK2_PHOSPHO_SITE 193-196; MYRISTYL 37-42; CK2_PHOSPHO_SITE 169-172; CK2_PHOSPHO_SITE 112-115; ASN_GLYCOSYLATION 104-107; CAMP_PHOSPHO_SITE 33-36; CK2_PHOSPHO_SITE 92-95; | |
| DEX0455_033.aa.1 | Y | 5 - i1-6; tm7-29; o30-48; tm49-71; i72-90; tm91-113; o114-141; tm142-164; i165-175; tm176-198; o199-261; | 34-40, 1.091; 4-32, 1.218; 89-113, 1.207; 234-258, 1.182; 203-232, 1.183; 141-167, 1.258; 169-201, 1.2; 53-74, 1.179; 78-84, 1.057; | PKC_PHOSPHO_SITE 248-250; MYRISTYL 53-58; MYRISTYL 161-166; MYRISTYL 104-109; MYRISTYL 139-144; MYRISTYL 183-188; MYRISTYL 159-164; PKC_PHOSPHO_SITE 233-235; MYRISTYL 141-146; MYRISTYL 64-69; MYRISTYL 156-161; CK2_PHOSPHO_SITE 27-30; MYRISTYL 10-15; MYRISTYL 190-195; MYRISTYL 23-28; CK2_PHOSPHO_SITE 119-122; MYRISTYL 68-73; MYRISTYL 55-60; MYRISTYL 152-157; | VACATPASE 149-175; ATP-synt_C 49-114; VACATPASE 176-199; VACATPASE 65-89; ATP-synt_C 135-200; |
| DEX0455_034.aa.1 | Y | 1 - i1-11; tm12-34; o35-499; | 315-320, 1.032; 247-254, 1.118; 434-444, 1.138; 409-419, 1.088; 328-355, 1.171; 270-283, 1.163; 379-385, 1.079; 113-132, 1.192; 142-152, 1.084; 366-372, 1.056; 10-33, 1.215; 36-53, | MYRISTYL 281-286; MYRISTYL 457-462; PKC_PHOSPHO_SITE 450-452; ASN_GLYCOSYLATION 235-238; ASN_GLYCOSYLATION 66-69; MYRISTYL 423-428; MYRISTYL 454-459; MYRISTYL 282-287; PKC_PHOSPHO_SITE 80-82; MYRISTYL 310-315; CK2_PHOSPHO_SITE 225-228; MYRISTYL 426-431; MYRISTYL 422-427; MYRISTYL 161-166; CK2_PHOSPHO_SITE 374-377; RGD 193-195; MYRISTYL 472-477; MYRISTYL 212-217; MYRISTYL 29-34; MYRISTYL 313-318; MYRISTYL 482-487; MYRISTYL 43-48; PKC_PHOSPHO_SITE 242-244; PKC_PHOSPHO_SITE 440-442; PKC_PHOSPHO_SITE 490-492; PKC_PHOSPHO_SITE 148-150; CK2_PHOSPHO_SITE 350-353; | ldl_recept_a 333-371; Kunitz_BPTI 250-300; sp_Q99J04_Q99J04_MOUSE 250-300; Kunitz_BPTI 391-441; LDLa 334-371; LDLRA_2 334-370; LDLRA_1 347-369; BPTI_KUNITZ_2_2 391-441; BPTI_KUNITZ_1 419-437; BPTI_KUNITZ_1 278-296; BPTI_KUNITZ_2_1 250-300; BASICPTASE 275-285; KU 389-442; |

-continued

| DEX ID | Sig P | TMHMM | Antigenicity | PTM | Domains |
|---|---|---|---|---|---|
| | | | 1.085; 84-105, 1.209; 55-67, 1.131; 168-183, 1.161; 388-403, 1.136; 235-243, 1.176; 256-262, 1.043; 216-227, 1.151; 293-303, 1.148; 462-486, 1.137; | MYRISTYL 494-499; PKC_PHOSPHO_SITE 253-255; CK2_PHOSPHO_SITE 74-77; MYRISTYL 285-290; PKC_PHOSPHO_SITE 386-388; | sp_Q99J04_Q99J04_MOUSE 391-441; BASICPTASE 426-441; BASICPTASE 247-261; KU 248-301; |
| DEX0455_034.aa.3 | Y | 1 - i1-11; tm12-34; o35-344; | 315-320, 1.032; 270-283, 1.163; 293-303, 1.148; 142-152, 1.084; 10-33, 1.215; 36-53, 1.085; 168-183, 1.161; 216-227, 1.151; 330-341, 1.103; 256-262, 1.043; 84-105, 1.209; 55-67, 1.131; 113-132, 1.192; 247-254, 1.118; 235-243, 1.176; | ASN_GLYCOSYLATION 235-238; MYRISTYL 285-290; CK2_PHOSPHO_SITE 74-77; PKC_PHOSPHO_SITE 242-244; MYRISTYL 282-287; CK2_PHOSPHO_SITE 225-228; MYRISTYL 281-286; PKC_PHOSPHO_SITE 253-255; MYRISTYL 43-48; RGD 193-195; MYRISTYL 161-166; ASN_GLYCOSYLATION 66-69; PKC_PHOSPHO_SITE 148-150; MYRISTYL 212-217; MYRISTYL 313-318; MYRISTYL 29-34; PKC_PHOSPHO_SITE 80-82; MYRISTYL 310-315; | BPTI_KUNITZ_2 250-300; BASICPTASE 247-261; sp_Q99J04_Q99J04_MOUSE 250-300; KU 248-301; BPTI_KUNITZ_1 278-296; BASICPTASE 275-285; BASICPTASE 285-300; Kunitz_BPTI 250-300; |
| DEX0455_034.aa.4 | N | 0 - o1-479; | 431-437, 1.056; 207-217, 1.084; 335-348, 1.163; 444-450, 1.079; 300-308, 1.176; 9-16, 1.07; 101-118, 1.085; 380-385, 1.032; 54-61, 1.121; 120-132, 1.131; 233-248, 1.161; 312-319, 1.118; 75-98, 1.215; 178-197, 1.192; 466-476, 1.107; 393-420, 1.171; 281-292, 1.151; | CK2_PHOSPHO_SITE 439-442; MYRISTYL 94-99; CK2_PHOSPHO_SITE 290-293; PKC_PHOSPHO_SITE 451-453; MYRISTYL 226-231; MYRISTYL 277-282; PKC_PHOSPHO_SITE 307-309; MYRISTYL 462-467; MYRISTYL 378-383; CK2_PHOSPHO_SITE 415-418; MYRISTYL 350-355; PKC_PHOSPHO_SITE 213-215; ASN_GLYCOSYLATION 131-134; MYRISTYL 347-352; MYRISTYL 375-380; PKC_PHOSPHO_SITE 318-320; MYRISTYL 346-351; MYRISTYL 464-469; CK2_PHOSPHO_SITE 139-142; MYRISTYL 108-113; PKC_PHOSPHO_SITE 145-147; ASN_GLYCOSYLATION 300-303; RGD 258-260; AMIDATION 61-64; | LDLRA_1 412-434; KU 313-366; LDLa 399-436; BASICPTASE 340-350; BASICPTASE 312-326; Kunitz_BPTI 315-365; sp_Q99J04_Q99J04_MOUSE 315-365; BASICPTASE 350-365; ldl_recept_a 398-436; BPTI_KUNITZ_2 315-365; LDLRA_2 399-435; BPTI_KUNITZ_1 343-361; |

-continued

| DEX ID | Sig P | TMHMM | Antigenicity | PTM | Domains |
|---|---|---|---|---|---|
| | | | 321-327, 1.043; 149-170, 1.209; 457-463, 1.098; 358-368, 1.148; 37-46, 1.091; | | |
| DEX0455_035.aa.1 | N | 1-i1-92; tm93-115; o116-121; | 81-101, 1.213; 103-118, 1.241; 54-62, 1.049; | MYRISTYL 54-59; MYRISTYL 40-45; PKC_PHOSPHO_SITE 119-121; | |
| DEX0455_035.orf.2 | N | 1-o1-125; tm126-148; i149-149; | 21-32, 1.239; 111-146, 1.245; 57-64, 1.082; 69-84, 1.089; 4-11, 1.052; 86-95, 1.131; 34-47, 1.143; | PKC_PHOSPHO_SITE 30-32; MYRISTYL 46-51; MYRISTYL 45-50; MYRISTYL 7-12; MYRISTYL 49-54; PKC_PHOSPHO_SITE 53-55; | |
| DEX0455_035.aa.2 | N | 1-i1-92; tm93-115; o116-121; | 54-62, 1.049; 103-118, 1.241; 81-101, 1.213; | MYRISTYL 54-59; PKC_PHOSPHO_SITE 119-121; MYRISTYL 40-45; | |
| DEX0455_035.orf.3 | N | 1-o1-125; tm126-148; i149-149; | 34-47, 1.143; 57-64, 1.082; 21-32, 1.239; 86-95, 1.131; 4-11, 1.052; 111-146, 1.245; 69-84, 1.089; | MYRISTYL 7-12; PKC_PHOSPHO_SITE 53-55; MYRISTYL 45-50; MYRISTYL 49-54; MYRISTYL 46-51; PKC_PHOSPHO_SITE 30-32; | |
| DEX0455_035.aa.3 | Y | 1-o1-71; tm72-94; i95-101; | 34-42, 1.049; 61-81, 1.213; 83-98, 1.241; 4-12, 1.132; | MYRISTYL 20-25; MYRISTYL 34-39; PKC_PHOSPHO_SITE 99-101; | |
| DEX0455_036.orf.1 | N | 1-o1-40; tm41-63; i64-95; | 39-66, 1.248; 76-92, 1.111; 15-24, 1.133; | TYR_PHOSPHO_SITE 68-75; PKC_PHOSPHO_SITE 66-68; MYRISTYL 61-66; CK2_PHOSPHO_SITE 87-90; PKC_PHOSPHO_SITE 65-67; ASN_GLYCOSYLATION 11-14; MYRISTYL 53-58; | |
| DEX0455_036.aa.1 | N | 1-o1-54; tm55-77; i78-109; | 53-80, 1.248; 4-16, 1.142; 29-38, 1.133; 90-106, 1.111; | TYR_PHOSPHO_SITE 82-89; MYRISTYL 75-80; CK2_PHOSPHO_SITE 101-104; PKC_PHOSPHO_SITE 80-82; MYRISTYL 67-72; ASN_GLYCOSYLATION 25-28; PKC_PHOSPHO_SITE 79-81; MYRISTYL 10-15; | G_PROTEIN_RECEP_F1_1 18-34; |
| DEX0455_036.aa.2 | N | 0-o1-1485; | 427-433, 1.051; 715-725, 1.093; 1161-1180, 1.113; 1009-1017, 1.062; 1369-1374, 1.054; 1428-1480, 1.146; 673-683, 1.16; 594-600, 1.049; | PKC_PHOSPHO_SITE 1000-1002; MYRISTYL 191-196; CK2_PHOSPHO_SITE 440-443; ASN_GLYCOSYLATION 338-341; TYR_PHOSPHO_SITE 237-245; CK2_PHOSPHO_SITE 986-989; ASN_GLYCOSYLATION 806-809; PKC_PHOSPHO_SITE 1415-1417; ASN_GLYCOSYLATION 1385-1388; MYRISTYL 35-40; PKC_PHOSPHO_SITE 837-839; ASN_GLYCOSYLATION 478-481; PKC_PHOSPHO_SITE 1148-1150; CK2_PHOSPHO_SITE 82-85; MYRISTYL 124-129; | SEA_1 757-823; SEA_2 913-979; |

-continued

| DEX ID | Sig P | TMHMM | Antigenicity | PTM | Domains |
|---|---|---|---|---|---|
| | | | 170-199, 1.136; 1388-1401, 1.161; 126-132, 1.062; 809-823, 1.119; 405-413, 1.091; 104-110, 1.07; 480-511, 1.148; 1405-1417, 1.159; 1356-1366, 1.086; 895-901, 1.051; 49-61, 1.148; 73-89, 1.07; 114-121, 1.085; 14-43, 1.136; 416-422, 1.032; 1195-1210, 1.091; 873-880, 1.078; 341-355, 1.139; 1061-1081, 1.165; 1051-1059, 1.101; 135-145, 1.171; 572-578, 1.043; 537-557, 1.079; 603-620, 1.171; 1341-1351, 1.091; 742-747, 1.017; 1276-1305, 1.178; 1022-1027, 1.076; 853-869, 1.079; 987-998, 1.127; 750-756, 1.049; 1241-1253, 1.146; 260-266, 1.074; 561-568, 1.078; 517-527, 1.127; 583-589, 1.035; 1255-1269, 1.16; 437-443, 1.069; 361-374, 1.127; 649-667, 1.12; 1120-1134, 1.119; | PKC_PHOSPHO_SITE 525-527; ASN_GLYCOSYLATION 457-460; MYRISTYL 436-441; PKC_PHOSPHO_SITE 318-320; CK2_PHOSPHO_SITE 550-553; CK2_PHOSPHO_SITE 1275-1278; CK2_PHOSPHO_SITE 50-53; CK2_PHOSPHO_SITE 362-365; PKC_PHOSPHO_SITE 102-104; CK2_PHOSPHO_SITE 674-677; MYRISTYL 47-52; ASN_GLYCOSYLATION 790-793; ASN_GLYCOSYLATION 1235-1238; ASN_GLYCOSYLATION 1365-1368; PKC_PHOSPHO_SITE 681-683; CK2_PHOSPHO_SITE 862-865; ASN_GLYCOSYLATION 1029-1032; PKC_PHOSPHO_SITE 1038-1040; MYRISTYL 659-664; ASN_GLYCOSYLATION 634-637; PKC_PHOSPHO_SITE 636-638; ASN_GLYCOSYLATION 1081-1084; MYRISTYL 1126-1131; MYRISTYL 954-959; CK2_PHOSPHO_SITE 206-209; PKC_PHOSPHO_SITE 1103-1105; ASN_GLYCOSYLATION 650-653; CK2_PHOSPHO_SITE 518-521; PKC_PHOSPHO_SITE 258-260; PKC_PHOSPHO_SITE 1097-1099; ASN_GLYCOSYLATION 1117-1120; MYRISTYL 983-988; ASN_GLYCOSYLATION 1101-1104; ASN_GLYCOSYLATION 769-772; ASN_GLYCOSYLATION 301-304; MYRISTYL 503-508; ASN_GLYCOSYLATION 1018-1021; ASN_GLYCOSYLATION 322-325; ASN_GLYCOSYLATION 925-928; PKC_PHOSPHO_SITE 746-748; ASN_GLYCOSYLATION 613-616; PKC_PHOSPHO_SITE 948-950; PKC_PHOSPHO_SITE 786-788; CK2_PHOSPHO_SITE 830-833; PKC_PHOSPHO_SITE 162-164; MYRISTYL 1255-1260; PKC_PHOSPHO_SITE 347-349; PKC_PHOSPHO_SITE 882-884; PKC_PHOSPHO_SITE 942-944; MYRISTYL 203-208; MYRISTYL 971-976; PKC_PHOSPHO_SITE 324-326; ASN_GLYCOSYLATION 946-949; PKC_PHOSPHO_SITE 792-794; CK2_PHOSPHO_SITE 1173-1176; PKC_PHOSPHO_SITE 570-572; PKC_PHOSPHO_SITE 733-735; PKC_PHOSPHO_SITE 1268-1270; MYRISTYL 1227-1232; MYRISTYL 904-909; PKC_PHOSPHO_SITE 213-215; PKC_PHOSPHO_SITE 1337-1339; PKC_PHOSPHO_SITE 1231-1233; TYR_PHOSPHO_SITE 1002-1009; PKC_PHOSPHO_SITE 168-170; MYRISTYL 815-820; ASN_GLYCOSYLATION 166-169; PKC_PHOSPHO_SITE 474-476; CK2_PHOSPHO_SITE 1425-1428; MYRISTYL 1426-1431; CK2_PHOSPHO_SITE 1141-1144; ASN_GLYCOSYLATION 10-13; ASN_GLYCOSYLATION 1214-1217; PKC_PHOSPHO_SITE 57-59; | |

-continued

| DEX ID | Sig P | TMHMM | Antigenicity | PTM | Domains |
|---|---|---|---|---|---|
| | | | 759-769, 1.186; 1142-1150, 1.127; 1311-1324, 1.069; 448-457, 1.171; 205-221, 1.105; 1029-1037, 1.068; 529-535, 1.029; 950-979, 1.128; 229-257, 1.102; 904-925, 1.198; 271-277, 1.063; 697-708, 1.073; 326-335, 1.128; 1105-1114, 1.128; 794-806, 1.128; 93-101, 1.078; 385-396, 1.062; 829-839, 1.135; 1040-1046, 1.055; 884-890, 1.07; 1184-1192, 1.078; 638-647, 1.128; 282-301, 1.181; | PKC_PHOSPHO_SITE 630-632; PKC_PHOSPHO_SITE 12-14; MYRISTYL 1422-1427; PKC_PHOSPHO_SITE 1193-1195; ASN_GLYCOSYLATION 145-148; PKC_PHOSPHO_SITE 6-8; | |
| DEX0455_036.orf.3 | N | 1 - o1-56; tm57-79; i80-111; | | MYRISTYL 12-17; PKC_PHOSPHO_SITE 81-83; CK2_PHOSPHO_SITE 103-106; TYR_PHOSPHO_SITE 84-91; ASN_GLYCOSYLATION 11-14; PKC_PHOSPHO_SITE 82-84; MYRISTYL 69-74; MYRISTYL 11-16; ASN_GLYCOSYLATION 10-13; TYR_PHOSPHO_SITE 6-12; MYRISTYL 77-82; | |
| DEX0455_036.aa.3 | N | 1 - o1-32; tm33-55; i56-87; | 8-16, 1.19; 68-84, 1.111; 31-58, 1.248; | MYRISTYL 53-58; TYR_PHOSPHO_SITE 60-67; CK2_PHOSPHO_SITE 79-82; PKC_PHOSPHO_SITE 58-60; MYRISTYL 45-50; PKC_PHOSPHO_SITE 57-59; | |
| DEX0455_036.orf.4 | N | 0 - o1-92; | 20-29, 1.064; 41-53, 1.181; 62-72, 1.212; 4-10, 1.151; | AMIDATION 34-37; PKC_PHOSPHO_SITE 51-53; MYRISTYL 56-61; PKC_PHOSPHO_SITE 88-90; PKC_PHOSPHO_SITE 62-64; MYRISTYL 61-66; | |
| DEX0455_036.aa.4 | N | 1 - o1-28; tm29-51; i52-83; | 64-80, 1.111; 27-54, 1.248; 4-13, 1.104; | PKC_PHOSPHO_SITE 54-56; MYRISTYL 49-54; MYRISTYL 41-46; CK2_PHOSPHO_SITE 75-78; PKC_PHOSPHO_SITE 53-55; TYR_PHOSPHO_SITE 56-63; | |
| DEX0455_037.aa.1 | Y | 0 - o1-225; | 199-205, 1.08; 60-72, 1.178; 150-159, 1.178; | MYRISTYL 124-129; CK2_PHOSPHO_SITE 154-157; PKC_PHOSPHO_SITE 189-191; PKC_PHOSPHO_SITE 106-108; CK2_PHOSPHO_SITE 109-112; | PGNDSYNTHASE 74-92; PGNDSYNTHASE 31-54; PGNDSYNTHASE |

-continued

| DEX ID | Sig P | TMHMM | Antigenicity | PTM | Domains |
|---|---|---|---|---|---|
| | | | 161-169, 1.13; 116-126, 1.06; 181-186, 1.025; 45-52, 1.052; 8-33, 1.189; 210-219, 1.123; 137-143, 1.07; 94-108, 1.076; | MYRISTYL 129-134; ASN_GLYCOSYLATION 78-81; PKC_PHOSPHO_SITE 109-111; MYRISTYL 144-149; CK2_PHOSPHO_SITE 158-161; MYRISTYL 100-105; MYRISTYL 133-138; ASN_GLYCOSYLATION 51-54; MYRISTYL 76-81; MYRISTYL 148-153; PKC_PHOSPHO_SITE 218-220; MYRISTYL 47-52; | 57-67; LIPOCALIN 33-46; lipocalin 38-221; |
| DEX0455_037.orf.2 | N | 0 - o1-349; | 294-307, 1.148; 108-114, 1.075; 200-209, 1.156; 320-335, 1.295; 263-275, 1.199; 15-38, 1.169; 246-252, 1.033; 6-12, 1.064; 87-93, 1.037; 237-242, 1.056; 45-70, 1.189; 132-149, 1.075; 97-102, 1.067; 338-346, 1.088; 159-172, 1.15; 309-315, 1.106; 219-225, 1.098; | PKC_PHOSPHO_SITE 215-217; PKC_PHOSPHO_SITE 173-175; MYRISTYL 185-190; AMIDATION 123-126; PKC_PHOSPHO_SITE 4-6; MYRISTYL 190-195; CAMP_PHOSPHO_SITE 228-231; PKC_PHOSPHO_SITE 179-181; MYRISTYL 223-228; MYRISTYL 116-121; PKC_PHOSPHO_SITE 83-85; PKC_PHOSPHO_SITE 226-228; CK2_PHOSPHO_SITE 256-259; PKC_PHOSPHO_SITE 120-122; AMIDATION 226-229; PKC_PHOSPHO_SITE 243-245; PKC_PHOSPHO_SITE 105-107; MYRISTYL 283-288; MYRISTYL 287-292; PKC_PHOSPHO_SITE 95-97; MYRISTYL 195-200; MYRISTYL 193-198; MYRISTYL 288-293; MYRISTYL 275-280; MYRISTYL 285-290; CAMP_PHOSPHO_SITE 1-4; MYRISTYL 99-104; | PRICHEXTENSN 247-263; PRICHEXTENSN 172-184; PRICHEXTENSN 339-349; PRICHEXTENSN 148-164; |
| DEX0455_037.aa.2 | Y | 0 - o1-413; | 369-374, 1.025; 283-295, 1.178; 349-357, 1.13; 338-347, 1.178; 50-56, 1.037; 268-275, 1.052; 387-393, 1.08; 193-201, 1.082; 317-332, 1.076; 218-224, 1.049; 231-240, 1.065; 60-65, 1.067; 71-77, 1.075; 129-135; 1.033; 8-33 1.189; 141-148, 1.121; 95-113, 1.107; 398-407, 1.123; | PKC_PHOSPHO_SITE 83-85; MYRISTYL 270-275; PKC_PHOSPHO_SITE 329-331; MYRISTYL 62-67; MYRISTYL 236-241; MYRISTYL 171-176; PKC_PHOSPHO_SITE 406-408; AMIDATION 256-259; MYRISTYL 154-159; MYRISTYL 168-173; AMIDATION 86-89; MYRISTYL 190-195; CK2_PHOSPHO_SITE 342-345; PKC_PHOSPHO_SITE 216-218; MYRISTYL 336-341; MYRISTYL 186-191; CK2_PHOSPHO_SITE 346-349; ASN_GLYCOSYLATION 301-304; PKC_PHOSPHO_SITE 162-164; CK2_PHOSPHO_SITE 177-180; MYRISTYL 256-261; MYRISTYL 323-328; ASN_GLYCOSYLATION 274-277; MYRISTYL 170-175; PKC_PHOSPHO_SITE 377-379; PKC_PHOSPHO_SITE 58-60; MYRISTYL 299-304; ASN_GLYCOSLATION 226-229; MYRISTYL 79-84; PKC_PHOSPHO_SITE 46-48; PKC_PHOSPHO_SITE 68-70; | LIPOCALIN 256-269; A1MCGLOBULIN 269-280; lipocalin 261-409; MAJORURINARY 263-281; VNEBNERGLAND 300-312; PGNDSYNTHASE 368-382; VNEBNERGLAND 371-394; LIPOCALIN 343-355; LIPOCALIN 260-272; VNEBNERGLAND 260-274; PGNDSYNTHASE 385-403; LIPOCALIN 371-386; A1MCGLOBULIN 366-387; MAJORURINARY 393-410; A1MCGLOBULIN 394-413; PGNDSYNTHASE 280-290; MAJORURINARY 365-386; PGNDSYNTHASE 332-335; A1MCGLOBULIN 334-353; PGNDSYNTHASE 254-277; |

-continued

| DEX ID | Sig P | TMHMM | Antigenicity | PTM | Domains |
|---|---|---|---|---|---|
| | | | | | PGNDSYNTHASE 297-315; |
| DEX0455_037.aa.3 | Y | 0 - o1-410; | 95-112, 1.075; 209-215, 1.033; 163-172, 1.156; 200-205, 1.056; 60-65, 1.067; 292-298, 1.068; 370-376, 1.106; 381-396, 1.295; 50-56, 1.037; 226-238, 1.199; 281-288, 1.078; 122-135, 1.15; 71-77, 1.075; 345-351, 1.103; 8-33, 1.189; 182-188, 1.098; 308-317, 1.074; 399-407, 1.088; 360-368, 1.106; | MYRISTYL 304-309; MYRISTYL 251-256; MYRISTYL 336-341; MYRISTYL 264-269; AMIDATION 285-288; MYRISTYL 148-153; CAMP_PHOSPHO_SITE 191-194; MYRISTYL 282-287; MYRISTYL 156-161; MYRISTYL 153-158; AMIDATION 189-192; PKC_PHOSPHO_SITE 189-191; MYRISTYL 250-255; PKC_PHOSPHO_SITE 136-138; PKC_PHOSPHO_SITE 142-144; MYRISTYL 299-304; AMIDATION 86-89; MYRISTYL 238-243; PKC_PHOSPHO_SITE 178-180; PKC_PHOSPHO_SITE 58-60; MYRISTYL 330-335; AMIDATION 339-342; MYRISTYL 79-84; PKC_PHOSPHO_SITE 68-70; MYRISTYL 186-191; MYRISTYL 318-323; PKC_PHOSPHO_SITE 206-208; CK2_PHOSPHO_SITE 219-222; MYRISTYL 322-327; MYRISTYL 274-279; PKC_PHOSPHO_SITE 83-85; MYRISTYL 248-253; MYRISTYL 246-251; PKC_PHOSPHO_SITE 46-48; MYRISTYL 158-163; MYRISTYL 326-331; MYRISTYL 62-67; | GLY_RICH 236-395; |
| DEX0455_037.aa.4 | Y | 0 - o1-135; | 38-44, 1.052; 8-36, 1.181; 109-115, 1.08; 46-89, 1.223; 120-129, 1.123; | MYRISTYL 71-76; PKC_PHOSPHO_SITE 99-101; MYRISTYL 54-59; ASN_GLYCOSYLATION 93-96; MYRISTYL 21-26; PKC_PHOSPHO_SITE 128-130; | PGNDSYNTHASE 90-104; PGNDSYNTHASE 107-125; |
| DEX0455_037.aa.5 | N | 0 - o1-150; | 110-116, 1.09; 11-27, 1.137; 75-102, 1.154; 137-147, 1.065; 47-53, 1.067; 38-45, 1.081; | MYRISTYL 62-67; MYRISTYL 51-56; ASN_GLYCOSYLATION 71-74; PKC_PHOSPHO_SITE 33-35; MYRISTYL 74-79; MYRISTYL 138-143; MYRISTYL 65-70; MYRISTYL 69-74; PKC_PHOSPHO_SITE 116-118; MYRISTYL 115-120; MYRISTYL 105-110; CK2_PHOSPHO_SITE 46-49; | |
| DEX0455_037.aa.6 | Y | 0 - o1-224; | 149-158, 1.178; 137-143, 1.07; 209-218, 1.123; 116-126, 1.06; 198-204, 1.08; 45-52, 1.052; 94-108, 1.076; 160-168, 1.13; 8-33, 1.189; 60-72, 1.178; 180-185, 1.025; | MYRISTYL 100-105; MYRISTYL 147-152; PKC_PHOSPHO_SITE 188-190; MYRISTYL 47-52; ASN_GLYCOSYLATION 51-54; MYRISTYL 124-129; PKC_PHOSPHO_SITE 106-108; CK2_PHOSPHO_SITE 109-112; MYRISTYL 129-134; CK2_PHOSPHO_SITE 153-156; ASN_GLYCOSYLATION 78-81; MYRISTYL 133-138; PKC_PHOSPHO_SITE 109-111; CK2_PHOSPHO_SITE 157-160; MYRISTYL 76-81; PKC_PHOSPHO_SITE 217-219; | LIPOCALIN 33-46; lipocalin 38-220; PGNDSYNTHASE 31-54; PGNDSYNTHASE 57-67; PGNDSYNTHASE 74-92; |
| DEX0455_037.aa.7 | Y | 0 - o1-481; | 458-464, 1.07; 281-288, 1.078; 381-393, 1.178; | MYRISTYL 156-161; MYRISTYL 336-341; PKC_PHOSPHO_SITE 58-60; PKC_PHOSPHO_SITE 68-70; MYRISTYL 79-84; CK2_PHOSPHO_SITE 430-433; | LIPOCALIN 354-367; PGNDSYNTHASE 395-413; PGNDSYNTHASE 352-375; |

-continued

| DEX ID | Sig P | TMHMM | Antigenicity | PTM | Domains |
|---|---|---|---|---|---|
| | | | 122-135, 1.15; 358-364, 1.026; 308-317, 1.074; 226-238, 1.199; 71-77, 1.075; 200-205, 1.056; 345-351, 1.103; 209-215, 1.033; 163-172, 1.156; 182-188, 1.098; 292-298, 1.068; 60-65, 1.067; 415-429, 1.076; 50-56, 1.037; 95-112, 1.075; 366-373, 1.052; 8-33, 1.189; 437-447, 1.06; | MYRISTYL 282-287; MYRISTYL 264-269; AMIDATION 285-288; MYRISTYL 445-450; MYRISTYL 330-335; MYRISTYL 318-323; PKC_PHOSPHO_SITE 46-48; PKC_PHOSPHO_SITE 136-138; PKC_PHOSPHO_SITE 83-85; ASN_GLYCOSYLATION 399-402; MYRISTYL 186-191; MYRISTYL 450-455; MYRISTYL 299-304; MYRISTYL 421-426; CAMP_PHOSPHO_SITE 191-194; MYRISTYL 454-459; MYRISTYL 238-243; PKC_PHOSPHO_SITE 427-429; MYRISTYL 62-67; PKC_PHOSPHO_SITE 206-208; MYRISTYL 246-251; AMIDATION 86-89; MYRISTYL 274-279; PKC_PHOSPHO_SITE 189-191; MYRISTYL 397-402; MYRISTYL 368-373; MYRISTYL 468-473; MYRISTYL 158-163; PKC_PHOSPHO_SITE 142-144; MYRISTYL 148-153; ASN_GLYCOSYLATION 372-375; CK2_PHOSPHO_SITE 219-222; MYRISTYL 304-309; MYRISTYL 250-255; MYRISTYL 251-256; PKC_PHOSPHO_SITE 472-474; MYRISTYL 322-327; MYRISTYL 153-158; AMIDATION 339-342; MYRISTYL 326-331; MYRISTYL 248-253; PKC_PHOSPHO_SITE 178-180; PKC_PHOSPHO_SITE 430-432; AMIDATION 189-192; | GLY_RICH 236-355; PGNDSYNTHASE 378-388; |
| DEX0455_038.aa.1 | N | 1-i1-8; tm9-31; o32-1088; | 605-611, 1.066; 944-955, 1.104; 810-816, 1.069; 542-551, 1.102; 674-692, 1.106; 879-897, 1.086; 765-778, 1.082; 1006-1012, 1.077; 518-531, 1.078; 856-863, 1.092; 462-468, 1.065; 174-186, 1.219; 1080-1085, 1.064; 822-829, 1.06; 144-172, 1.186; 565-571, 1.09; 841-849, 1.057; 712-722, 1.142; 731-752, 1.127; 130-135, 1.037; 661-667, 1.036; 89-127, 1.18; | AMIDATION 268-271; CK2_PHOSPHO_SITE 423-426; AMIDATION 278-281; AMIDATION 288-291; PKC_PHOSPHO_SITE 750-752; CAMP_PHOSPHO_SITE 476-479; PKC_PHOSPHO_SITE 722-724; CK2_PHOSPHO_SITE 632-635; PKC_PHOSPHO_SITE 164-166; AMIDATION 248-251; PKC_PHOSPHO_SITE 209-211; AMIDATION 338-341; PKC_PHOSPHO_SITE 525-527; PKC_PHOSPHO_SITE 481-483; CK2_PHOSPHO_SITE 781-784; PKC_PHOSPHO_SITE 32-34; CK2_PHOSPHO_SITE 135-138; ASN_GLYCOSYLATION 931-934; CK2_PHOSPHO_SITE 998-1001; AMIDATION 228-231; AMIDATION 318-321; CK2_PHOSPHO_SITE 1059-1062; AMIDATION 238-241; CK2_PHOSPHO_SITE 37-40; CK2_PHOSPHO_SITE 847-850; CK2_PHOSPHO_SITE 408-411; PKC_PHOSPHO_SITE 135-137; AMIDATION 308-311; AMIDATION 436-439; AMIDATION 396-399; PKC_PHOSPHO_SITE 539-541; AMIDATION 416-419; CK2_PHOSPHO_SITE 615-618; CK2_PHOSPHO_SITE 722-725; AMIDATION 426-429; MYRISTYL 186-191; AMIDATION 446-449; PKC_PHOSPHO_SITE 804-806; PKC_PHOSPHO_SITE 72-74; AMIDATION 368-371; | TROPOMYOSIN 622-639; TROPOMYOSIN 695-715; Rib_recp_KP_reg 33-716; LYS_RICH 47-82; TROPOMYOSIN 764-787; TROPOMYOSIN 831-856; |

-continued

| DEX ID | Sig P | TMHMM | Antigenicity | PTM | Domains |
|---|---|---|---|---|---|
| | | | 1039-1050, 1.161; 904-911, 1.142; 957-964, 1.055; 1017-1027, 1.15; 973-986, 1.075; 915-930, 1.17; 780-793, 1.075; 493-510, 1.135; 8-31, 1.182; 594-602, 1.136; 616-631, 1.118; | CK2_PHOSPHO_SITE 775-778; CK2_PHOSPHO_SITE 561-564; CK2_PHOSPHO_SITE 828-831; AMIDATION 218-221; AMIDATION 376-379; PKC_PHOSPHO_SITE 902-904; MYRISTYL 189-194; CK2_PHOSPHO_SITE 32-35; CK2_PHOSPHO_SITE 664-667; ASN_GLYCOSYLATION 207-210; CK2_PHOSPHO_SITE 36-39; AMIDATION 386-389; AMIDATION 198-201; AMIDATION 328-331; MYRISTYL 195-200; PKC_PHOSPHO_SITE 1070-1072; AMIDATION 348-351; AMIDATION 258-261; ASN_GLYCOSYLATION 91-94; PKC_PHOSPHO_SITE 1027-1029; MYRISTYL 1031-1036; | |
| DEX0455_038.orf.3 | N | 1 - i1-107; tm108-130; o131-440; | 49-58, 1.131; 243-271, 1.186; 188-226, 1.18; 107-130, 1.182; 16-27, 1.089; 64-96, 1.129; 229-234, 1.037; 273-285, 1.219; | PKC_PHOSPHO_SITE 263-265; AMIDATION 357-360; PKC_PHOSPHO_SITE 234-236; AMIDATION 297-300; AMIDATION 377-380; AMIDATION 327-330; CK2_PHOSPHO_SITE 136-139; CK2_PHOSPHO_SITE 234-237; PKC_PHOSPHO_SITE 308-310; AMIDATION 427-430; CK2_PHOSPHO_SITE 135-138; AMIDATION 317-320; AMIDATION 39-42; MYRISTYL 70-75; AMIDATION 347-350; AMIDATION 417-420; MYRISTYL 285-290; MYRISTYL 294-299; ASN_GLYCOSYLATION 190-193; MYRISTYL 7-12; CK2_PHOSPHO_SITE 131-134; AMIDATION 43-46; PKC_PHOSPHO_SITE 131-133; AMIDATION 367-370; PKC_PHOSPHO_SITE 32-34; AMIDATION 387-390; PKC_PHOSPHO_SITE 59-61; PKC_PHOSPHO_SITE 171-173; ASN_GLYCOSYLATION 306-309; AMIDATION 407-410; AMIDATION 337-340; MYRISTYL 288-293; | LYS_RICH 146-181; Rib_recp_KP_reg 132-275; |
| DEX0455_038.aa.3 | Y | 1 - i1-8; tm9-31; o32-521; | 174-186, 1.219; 415-423, 1.129; 130-135, 1.037; 396-413, 1.186; 8-31, 1.182; 144-172, 1.186; 339-377, 1.18; 455-464, 1.102; 507-515, 1.136; 478-484, 1.09; 431-444, 1.078; 380-385, 1.037; 89-127, 1.18; | ASN_GLYCOSYLATION 91-94; MYRISTYL 417-422; MYRISTYL 189-194; PKC_PHOSPHO_SITE 438-440; PKC_PHOSPHO_SITE 452-454; MYRISTYL 186-191; PKC_PHOSPHO_SITE 135-137; AMIDATION 228-231; PKC_PHOSPHO_SITE 209-211; AMIDATION 238-241; PKC_PHOSPHO_SITE 519-521; AMIDATION 198-201; PKC_PHOSPHO_SITE 164-166; CK2_PHOSPHO_SITE 32-35; AMIDATION 248-251; PKC_PHOSPHO_SITE 385-387; AMIDATION 258-261; MYRISTYL 195-200; CK2_PHOSPHO_SITE 135-138; AMIDATION 278-281; PKC_PHOSPHO_SITE 72-74; AMIDATION 308-311; CK2_PHOSPHO_SITE 474-477; CK2_PHOSPHO_SITE 413-416; AMIDATION 218-221; PKC_PHOSPHO_SITE 32-34; AMIDATION 318-321; CK2_PHOSPHO_SITE 385-388; | Rib_recp_KP_reg 278-426; LYS_RICH 47-82; Rib_recp_KP_reg 33-176; |

-continued

| DEX ID | Sig P | TMHMM | Antigenicity | PTM | Domains |
|---|---|---|---|---|---|
| DEX0455_039.aa.1 | Y | 0 - o1-165; | 53-71, 1.107; 74-80, 1.034; 86-93, 1.108; 6-30, 1.126; 34-40, 1.082; 125-132, 1.062; | AMIDATION 288-291; AMIDATION 268-271; CK2_PHOSPHO_SITE 37-40; AMIDATION 328-331; CK2_PHOSPHO_SITE 36-39; ASN_GLYCOSYLATION 207-210; PKC_PHOSPHO_SITE 72-74; MYRISTYL 41-46; MYRISTYL 78-83; CK2_PHOSPHO_SITE 110-113; AMIDATION 157-160; PKC_PHOSPHO_SITE 3-5; CK2_PHOSPHO_SITE 121-124; MYRISTYL 76-81; CK2_PHOSPHO_SITE 117-120; CK2_PHOSPHO_SITE 119-122; CK2_PHOSPHO_SITE 32-35; AMIDATION 152-155; CK2_PHOSPHO_SITE 66-69; MYRISTYL 45-50; | LYS_RICH 141-161; |
| DEX0455_039.aa.2 | N | 0 - o1-262; | 103-113, 1.095; 74-80, 1.034; 210-229, 1.107; 6-30, 1.126; 118-132, 1.11; 86-93, 1.108; 53-71, 1.107; 139-168, 1.129; 174-207, 1.173; 34-40, 1.082; | MYRISTYL 76-81; AMIDATION 254-257; MYRISTYL 112-117; PKC_PHOSPHO_SITE 3-5; CK2_PHOSPHO_SITE 66-69; AMIDATION 249-252; MYRISTYL 41-46; MYRISTYL 173-178; MYRISTYL 45-50; PKC_PHOSPHO_SITE 72-74; CK2_PHOSPHO_SITE 32-35; MYRISTYL 78-83; | LYS_RICH 238-258; |
| DEX0455_040.orf.1 | Y | 0 - o1-231; | | CK2_PHOSPHO_SITE 51-54; MYRISTYL 88-93; CK2_PHOSPHO_SITE 98-101; RGD 219-221; PKC_PHOSPHO_SITE 223-225; CK2_PHOSPHO_SITE 108-111; MYRISTYL 91-96; PKC_PHOSPHO_SITE 190-192; MYRISTYL 183-188; MYRISTYL 212-217; MYRISTYL 42-47; MYRISTYL 204-209; ASN_GLYCOSYLATION 112-115; MYRISTYL 186-191; MYRISTYL 216-221; ASN_GLYCOSYLATION 75-78; MYRISTYL 24-29; MYRISTYL 182-187; PKC_PHOSPHO_SITE 119-121; MYRISTYL 87-92; | BPTI_KUNITZ_2_1 56-106; BASICPTASE 53-67; BPTI_KUNITZ_1 179-197; KU 54-107; BASICPTASE 91-106; sp_O43291_SPT2_HUMAN 56-106; sp_O43291_SPT2_HUMAN 151-201; Kunitz_BPTI 151-201; KU 149-202; Kunitz_BPTI 56-106; BASICPTASE 81-91; BPTI_KUNITZ_2_2 151-201; BPTI_KUNITZ_1 84-102; |
| DEX0455_040.aa.1 | Y | 0 - o1-213; | 60-70, 1.189; 107-113, 1.087; 147-153, 1.047; 178-188, 1.133; 81-91, 1.13; 130-136, 1.11; 10-28, 1.181; 138-145, 1.083; 35-47, 1.25; | MYRISTYL 69-74, CK2_PHOSPHO_SITE 80-83; MYRISTYL 195-200; MYRISTYL 207-212; PKC_PHOSPHO_SITE 204-206; CK2_PHOSPHO_SITE 90-93; MYRISTYL 70-75; MYRISTYL 73-78; MYRISTYL 203-208; MYRISTYL 168-173; ASN_GLYCOSYLATION 94-97; ASN_GLYCOSYLATION 57-60; PKC_PHOSPHO_SITE 172-174; MYRISTYL 6-11; MYRISTYL 165-170; PKC_PHOSPHO_SITE 101-103; MYRISTYL 198-203; MYRISTYL 164-169; CK2_PHOSPHO_SITE 33-36; MYRISTYL 24-29; | KU 131-184; Kunitz_BPTI 38-88; BASICPTASE 35-49; sp_O43291_SPT2_HUMAN 133-183; BPTI_KUNITZ_1 66-84; BPTI_KUNITZ_2_2 133-183; BPTI_KUNITZ_1 161-179; BASICPTASE 73-88; Kunitz_BPTI 133-183; BPTI_KUNITZ_2_1 38-88; KU 36-89; sp_O43291_SPT2_HUMAN 38-88; BASICPTASE 63-73; |

-continued

| DEX ID | Sig P | TMHMM | Antigenicity | PTM | Domains |
|---|---|---|---|---|---|
| DEX0455_040.aa.2 | Y | 0 - o1-242; | 35-47, 1.25; 107-113, 1.087; 201-239, 1.186; 178-186, 1.133; 130-136, 1.11; 138-145, 1.083; 189-195, 1.083; 10-28, 1.181; 81-91, 1.13; 60-70, 1.189; 147-153, 1.047; | MYRISTYL 73-78; MYRISTYL 6-11; MYRISTYL 168-173; ASN_GLYCOSYLATION 94-97; CK2_PHOSPHO_SITE 33-36; PKC_PHOSPHO_SITE 172-174; MYRISTYL 70-75; MYRISTYL 69-74; PKC_PHOSPHO_SITE 101-103; ASN_GLYCOSYLATION 57-60; CK2_PHOSPHO_SITE 214-217; CK2_PHOSPHO_SITE 90-93; MYRISTYL 164-169; MYRISTYL 24-29; CK2_PHOSPHO_SITE 80-83; MYRISTYL 165-170; | Kunitz_BPTI 38-88; KU 131-184; BPTI_KUNITZ_2_2 133-183; sp_O43291_SPT2_HUMAN 38-88; BPTI_KUNITZ_1 66-84; sp_O43291_SPT2_HUMAN 133-183; BPTI_KUNITZ_2_1 38-88; BPTI_KUNITZ_1 161-179; Kunitz_BPTI 133-183; BASICPTASE 73-88; BASICPTASE 63-73; KU 36-89; BASICPTASE 35-49; |
| DEX0455_041.orf.1 | N | 0 - o1-53; | 16-21, 1.006; 4-11, 1.105; | PKC_PHOSPHO_SITE 21-23; PKC_PHOSPHO_SITE 42-44; PKC_PHOSPHO_SITE 20-22; MYRISTYL 7-12; | |
| DEX0455_041.aa.1 | N | 0 - o1-43; | 33-38, 1.046; 5-20, 1.129; | MYRISTYL 28-33; MYRISTYL 6-11; ASN_GLYCOSYLATION 32-35; | |
| DEX0455_041.orf.2 | N | 0 - o1-66; | 4-17, 1.129; 30-35, 1.046; | ASN_GLYCOSYLATION 29-32; MYRISTYL 25-30; PKC_PHOSPHO_SITE 55-57; | |
| DEX0455_041.aa.2 | Y | 0 - i1-34; | 6-18, 1.141; 25-31, 1.103; | | |
| DEX0455_042.orf.1 | N | 0 - o1-116; | | PKC_PHOSPHO_SITE 3-5; MYRISTYL 10-15; CK2_PHOSPHO_SITE 7-10; ASN_GLYCOSYLATION 75-78; AMIDATION 40-43; PKC_PHOSPHO_SITE 41-43; CK2_PHOSPHO_SITE 81-84; CK2_PHOSPHO_SITE 36-39; ASN_GLYCOSYLATION 34-37; CK2_PHOSPHO_SITE 72-75; TYR_PHOSPHO_SITE 51-59; CK2_PHOSPHO_SITE 93-96; ASN_GLYCOSYLATION 80-83; PKC_PHOSPHO_SITE 29-31; TYR_PHOSPHO_SITE 40-48; CK2_PHOSPHO_SITE 82-85; CK2_PHOSPHO_SITE 17-20; CK2_PHOSPHO_SITE 56-59; CAMP_PHOSPHO_SITE 69-72; CK2_PHOSPHO_SITE 71-74; CK2_PHOSPHO_SITE 112-115; CK2_PHOSPHO_SITE 76-79; CAMP_PHOSPHO_SITE 42-45; TYR_PHOSPHO_SITE 50-57; PKC_PHOSPHO_SITE 44-46; CK2_PHOSPHO_SITE 77-80; TYR_PHOSPHO_SITE 24-31; CAMP_PHOSPHO_SITE 4-7; PKC_PHOSPHO_SITE 113-115; PKC_PHOSPHO_SITE 71-73; TYR_PHOSPHO_SITE 35-41; | |
| DEX0455_042.aa.1 | N | 0 - o1-122; | | MYRISTYL 8-13; CK2_PHOSPHO_SITE 87-90; PKC_PHOSPHO_SITE 9-11; CK2_PHOSPHO_SITE 99-102; PKC_PHOSPHO_SITE 47-49; AMIDATION 46-49; CK2_PHOSPHO_SITE 23-26; ASN_GLYCOSYLATION 40-43; TYR_PHOSPHO_SITE 30-37; CK2_PHOSPHO_SITE 88-91; MYRISTYL 16-21; PKC_PHOSPHO_SITE 35-37; CAMP_PHOSPHO_SITE 48-51; | |

-continued

| DEX ID | Sig P | TMHMM | Antigenicity | PTM | Domains |
|---|---|---|---|---|---|
| DEX0455_043.orf.1 | Y | 0 - o1-86; | 64-72, 1.133; 76-83, 1.14; 27-38, 1.086; 4-20, 1.192; 41-50, 1.137; | ASN_GLYCOSYLATION 7-10; PKC_PHOSPHO_SITE 87-89; TYR_PHOSPHO_SITE 41-47; CK2_PHOSPHO_SITE 42-45; MYRISTYL 3-8; ASN_GLYCOSYLATION 60-63; PKC_PHOSPHO_SITE 29-31; MYRISTYL 64-69; MYRISTYL 56-61; MYRISTYL 61-66; | |
| DEX0455_043.aa.1 | N | 0 - o1-30; | 11-26, 1.155; | CK2_PHOSPHO_SITE 24-27; | |
| DEX0455_043.orf.2 | N | 0 - o1-125; | | CK2_PHOSPHO_SITE 94-97; MYRISTYL 47-52; PKC_PHOSPHO_SITE 84-86; MYRISTYL 8-13; PKC_PHOSPHO_SITE 77-79; | |
| DEX0455_043.orf.3 | N | 0 - i1-104; | 89-95, 1.052; 59-67, 1.023; 10-38, 1.08; | PKC_PHOSPHO_SITE 42-44; CK2_PHOSPHO_SITE 34-37; MYRISTYL 9-14; PKC_PHOSPHO_SITE 45-47; PKC_PHOSPHO_SITE 3-5; ASN_GLYCOSYLATION 11-14; | |
| DEX0455_044.aa.1 | N | 1 - i1-31; tm32-54; o55-61; | 14-24, 1.177; 29-58, 1.199; | MYRISTYL 27-32; | |
| DEX0455_045.orf.1 | N | 0 - o1-193; | 178-190, 1.144; 135-145, 1.124; 121-128, 1.095; 70-111, 1.15; 25-46, 1.115; 51-66, 1.216; | AMIDATION 65-68; PKC_PHOSPHO_SITE 129-131; MYRISTYL 10-15; PKC_PHOSPHO_SITE 93-95; MYRISTYL 81-86; CAMP_PHOSPHO_SITE 175-178; AMIDATION 173-176; PKC_PHOSPHO_SITE 5-7; CAMP_PHOSPHO_SITE 110-113; MYRISTYL 83-88; CK2_PHOSPHO_SITE 167-170; | |
| DEX0455_045.aa.1 | N | 0 - o1-163; | 25-46, 1.115; 121-128, 1.095; 51-66, 1.216; 135-144, 1.081; 70-111, 1.15; | CK2_PHOSPHO_SITE 149-152; AMIDATION 65-68; PKC_PHOSPHO_SITE 5-7; MYRISTYL 10-15; CAMP_PHOSPHO_SITE 146-149; MYRISTYL 81-86; PKC_PHOSPHO_SITE 93-95; CAMP_PHOSPHO_SITE 110-113; MYRISTYL 83-88; PKC_PHOSPHO_SITE 129-131; | |
| DEX0455_046.orf.1 | N | 0 - o1-227; | | MYRISTYL 115-120; PKC_PHOSPHO_SITE 3-5; MYRISTYL 97-102; MYRISTYL 133-138; CAMP_PHOSPHO_SITE 163-166; CK2_PHOSPHO_SITE 3-6; MYRISTYL 3-8; | |
| DEX0455_046.aa.1 | N | 0 - o1-198; | 4-11, 1.144; 51-59, 1.107; 160-184, 1.151; 15-25, 1.11; 93-99, 1.11; 73-85, 1.118; 32-40, 1.076; 146-153, 1.088; | MYRISTYL 90-95; MYRISTYL 71-76; CK2_PHOSPHO_SITE 156-159; MYRISTYL 161-166; PKC_PHOSPHO_SITE 63-65; MYRISTYL 153-158; MYRISTYL 149-154; PKC_PHOSPHO_SITE 119-121; MYRISTYL 86-91; MYRISTYL 157-162; MYRISTYL 68-73; CAMP_PHOSPHO_SITE 120-123; MYRISTYL 104-109; | |
| DEX0455_047.orf.1 | N | 0 - o1-103; | 66-100, 1.232; 23-44, 1.101; 10-17, 1.088; | AMIDATION 14-17; PKC_PHOSPHO_SITE 73-75; CK2_PHOSPHO_SITE 33-36; PKC_PHOSPHO_SITE 59-61; MYRISTYL 96-101; | |
| DEX0455_047.aa.1 | Y | 0 - o1-65; | 42-48, 1.073; 55-62, 1.119; | ASN_GLYCOSYLATION 32-35; CK2_PHOSPHO_SITE 23-26; ASN_GLYCOSYLATION 39-42; | |

-continued

| DEX ID | Sig P | TMHMM | Antigenicity | PTM | Domains |
|---|---|---|---|---|---|
| | | | 4-30, 1.142; 32-40, 1.122; | MYRISTYL 19-24; | |
| DEX0455_047.orf.2 | N | 0 - o1-103; | 10-17, 1.088; 66-100, 1.232; 23-44, 1.101; | AMIDATION 14-17; CK2_PHOSPHO_SITE 33-36; MYRISTYL 96-101; PKC_PHOSPHO_SITE 73-75; PKC_PHOSPHO_SITE 59-61; | |
| DEX0455_047.aa.2 | N | 0 - o1-27; | | | |
| DEX0455_048.aa.1 | Y | 0 - o1-154; | 111-117, 1.077; 83-97, 1.104; 4-60, 1.197; 99-107, 1.051; 63-78, 1.095; 126-151, 1.156; | TYR_PHOSPHO_SITE 105-112; MYRISTYL 80-85; PKC_PHOSPHO_SITE 56-58; CK2_PHOSPHO_SITE 37-40; TYR_PHOSPHO_SITE 79-86; | |
| DEX0455_048.orf.2 | N | 0 - o1-176; | 151-173, 1.203; 86-100, 1.104; 114-120, 1.077; 129-141, 1.156; 102-110, 1.051; 66-81, 1.095; 4-63, 1.197; | PKC_PHOSPHO_SITE 169-171; MYRISTYL 83-88; PKC_PHOSPHO_SITE 59-61; TYR_PHOSPHO_SITE 108-115; CK2_PHOSPHO_SITE 40-43; TYR_PHOSPHO_SITE 82-89; CK2_PHOSPHO_SITE 24-27; | |
| DEX0455_048.aa.2 | N | 0 - o1-271; | 39-50, 1.182; 4-21, 1.232; 181-195, 1.104; 98-158, 1.148; 246-268, 1.203; 161-176, 1.095; 197-205, 1.051; 66-90, 1.192; 224-236, 1.156; 209-215, 1.077; 57-62, 1.053; | TYR_PHOSPHO_SITE 203-210; PKC_PHOSPHO_SITE 154-156; PKC_PHOSPHO_SITE 34-36; RGD 26-28; PKC_PHOSPHO_SITE 264-266; ASN_GLYCOSYLATION 95-98; MYRISTYL 38-43; PKC_PHOSPHO_SITE 21-23; CK2_PHOSPHO_SITE 88-91; TYR_PHOSPHO_SITE 177-184; MYRISTYL 178-183; CK2_PHOSPHO_SITE 135-138; PKC_PHOSPHO_SITE 96-98; CK2_PHOSPHO_SITE 119-122; | |
| DEX0455_049.aa.1 | N | 1 - o1-219; tm220-242; i243-268; | 199-209, 1.147; 129-139, 1.104; 95-105, 1.087; 4-24, 1.212; 219-244, 1.317; 58-63, 1.099; 145-153, 1.156; 69-76, 1.121; 86-93, 1.085; 163-172, 1.122; 176-182, 1.056; | PKC_PHOSPHO_SITE 243-245; MYRISTYL 66-71; TYR_PHOSPHO_SITE 105-111; MYRISTYL 77-82; PKC_PHOSPHO_SITE 154-156; CK2_PHOSPHO_SITE 88-91; MYRISTYL 217-222; MYRISTYL 9-14; PKC_PHOSPHO_SITE 81-83; ASN_GLYCOSYLATION 152-155; PKC_PHOSPHO_SITE 115-117; ASN_GLYCOSYLATION 28-31; AMIDATION 32-35; MYRISTYL 29-34; PKC_PHOSPHO_SITE 125-127; MYRISTYL 57-62; CK2_PHOSPHO_SITE 81-84; CK2_PHOSPHO_SITE 157-160; PKC_PHOSPHO_SITE 90-92; MYRISTYL 40-45; ASN_GLYCOSYLATION 65-68; PKC_PHOSPHO_SITE 182-184; | THYROGLOBULIN_1 49-77; thyroglobulin_1 20-89; TY 50-93; |
| DEX0455_049.aa.2 | N | 1 - o1-293; tm294-316; i317-342; | 237-246, 1.122; 52-67, 1.194; 169-179, 1.087; 132-137, 1.099; | MYRISTYL 10-15; ASN_GLYCOSYLATION 139-142; MYRISTYL 291-296; TYR_PHOSPHO_SITE 179-185; MYRISTYL 29-34; PKC_PHOSPHO_SITE 164-166; MYRISTYL 151-156; | TY 124-167; thyroglobulin_1 94-163; THYROGLOBULIN_1 123-151; |

| DEX ID | Sig P | TMHMM | Antigenicity | PTM | Domains |
|---|---|---|---|---|---|
| | | | 219-227, 1.156; 41-50, 1.059; 203-213, 1.104; 273-283, 1.147; 250-256, 1.056; 24-29, 1.038; 293-318, 1.317; 73-98, 1.193; 143-150, 1.121; 160-167, 1.085; | PKC_PHOSPHO_SITE 228-230; ASN_GLYCOSYLATION 25-28; CK2_PHOSPHO_SITE 231-234; MYRISTYL 32-37; MYRISTYL 140-145; CK2_PHOSPHO_SITE 155-158; PKC_PHOSPHO_SITE 317-319; MYRISTYL 103-108; PKC_PHOSPHO_SITE 155-157; PKC_PHOSPHO_SITE 256-258; MYRISTYL 114-119; ASN_GLYCOSYLATION 226-229; PKC_PHOSPHO_SITE 189-191; MYRISTYL 131-136; PKC_PHOSPHO_SITE 199-201; CK2_PHOSPHO_SITE 162-165; ASN_GLYCOSYLATION 102-105; AMIDATION 106-109; MYRISTYL 80-85; | |
| DEX0455_049.aa.3 | Y | 0 - o1-240; | 45-70, 1.193; 4-22, 1.166; 132-139, 1.085; 191-199, 1.156; 24-39, 1.194; 104-109, 1.099; 115-122, 1.121; 175-185, 1.104; 209-216, 1.122; 141-151, 1.087; 220-237, 1.155; | MYRISTYL 112-117; PKC_PHOSPHO_SITE 127-129; PKC_PHOSPHO_SITE 136-138; TYR_PHOSPHO_SITE 151-157; MYRISTYL 10-15; AMIDATION 78-81; ASN_GLYCOSYLATION 198-201; MYRISTYL 86-91; CK2_PHOSPHO_SITE 134-137; MYRISTYL 75-80; PKC_PHOSPHO_SITE 171-173; ASN_GLYCOSYLATION 74-77; PKC_PHOSPHO_SITE 200-202; MYRISTYL 123-128; MYRISTYL 52-57; MYRISTYL 103-108; CK2_PHOSPHO_SITE 127-130; CK2_PHOSPHO_SITE 203-206; PKC_PHOSPHO_SITE 161-163; ASN_GLYCOSYLATION 111-114; | thyroglobulin_1 66-135; TY 96-139; THYROGLOBULIN_1 95-123; |
| DEX0455_049.aa.4 | Y | 1 - o1-341; tm342-364; i365-390; | 191-198, 1.121; 251-261, 1.104; 4-23, 1.166; 217-227, 1.087; 321-331, 1.147; 298-304, 1.056; 341-366, 1.317; 208-215, 1.085; 267-275, 1.156; 180-185, 1.099; 285-294, 1.122; 92-115, 1.194; 121-146, 1.193; 71-77, 1.09; | PKC_PHOSPHO_SITE 212-214; CK2_PHOSPHO_SITE 203-206; AMIDATION 154-157; PKC_PHOSPHO_SITE 247-249; PKC_PHOSPHO_SITE 365-367; PKC_PHOSPHO_SITE 94-96; MYRISTYL 151-156; PKC_PHOSPHO_SITE 304-306; CK2_PHOSPHO_SITE 48-51; MYRISTYL 10-15; MYRISTYL 188-193; PKC_PHOSPHO_SITE 237-239; ASN_GLYCOSYLATION 150-153; MYRISTYL 179-184; TYR_PHOSPHO_SITE 227-233; PKC_PHOSPHO_SITE 70-72; RGD 66-68; ASN_GLYCOSYLATION 274-277; PKC_PHOSPHO_SITE 203-205; MYRISTYL 39-44; AMIDATION 81-84; MYRISTYL 128-133; PKC_PHOSPHO_SITE 276-278; MYRISTYL 162-167; ASN_GLYCOSYLATION 187-190; MYRISTYL 199-204; CK2_PHOSPHO_SITE 210-213; MYRISTYL 339-344; CK2_PHOSPHO_SITE 279-282; | thyroglobulin_1 142-211; TY 172-215; THYROGLOBULIN_1 171-199; |
| DEX0455_049.aa.5 | Y | 1 - o1-265; tm266-288; i289-314; | 4-22, 1.166; 115-122, 1.133; 132-139, 1.085; 222-228, 1.056; 191-199, 1.156; 245-255, 1.147; | MYRISTYL 86-91; ASN_GLYCOSYLATION 198-201; PKC_PHOSPHO_SITE 127-129; PKC_PHOSPHO_SITE 228-230; MYRISTYL 75-80; MYRISTYL 52-57; MYRISTYL 103-108; CK2_PHOSPHO_SITE 127-130; PKC_PHOSPHO_SITE 289-291; PKC_PHOSPHO_SITE 200-202; TYR_PHOSPHO_SITE 151-157; MYRISTYL 123-128; CK2_PHOSPHO_SITE 203-206; | thyroglobulin_1 66-135; TY 96-139; THYROGLOBULIN_1 95-123; |

-continued

| DEX ID | Sig P | TMHMM | Antigenicity | PTM | Domains |
|---|---|---|---|---|---|
| | | | 141-151, 1.087; 45-70, 1.193; 209-218, 1.122; 175-185, 1.104; 24-39, 1.194; 104-109, 1.099; 265-290, 1.317; | PKC_PHOSPHO_SITE 136-138; ASN_GLYCOSYLATION 111-114; MYRISTYL 263-268; AMIDATION 78-81; CK2_PHOSPHO_SITE 134-137; ASN_GLYCOSYLATION 74-77; PKC_PHOSPHO_SITE 161-163; PKC_PHOSPHO_SITE 171-173; MYRISTYL 10-15; MYRISTYL 112-117; | |
| DEX0455_050.orf.1 | Y | 1 - i1-11; tm12-31; o32-122; | 60-71, 1.212; 79-93, 1.103; 97-119, 1.218; 37-45, 1.137; 12-34, 1.192; | CK2_PHOSPHO_SITE 72-75; PKC_PHOSPHO_SITE 39-41; PKC_PHOSPHO_SITE 113-115; ASN_GLYCOSYLATION 2-5; CK2_PHOSPHO_SITE 4-7; | PHE_RICH 18-29; |
| DEX0455_050.aa.1 | Y | 0 - o1-48; | 9-25, 1.107; 40-45, 1.135; | PKC_PHOSPHO_SITE 4-6; CK2_PHOSPHO_SITE 31-34; MYRISTYL 16-21; | ACTINS_2 29-37; |
| DEX0455_051.aa.1 | N | 0 - o1-596; | 130-149, 1.131; 509-519, 1.077; 40-45, 1.041; 523-540, 1.153; 215-230, 1.13; 99-105, 1.045; 397-422, 1.135; 239-258, 1.127; 573-579, 1.113; 327-334, 1.141; 369-383, 1.122; 428-443, 1.091; 470-477, 1.104; 58-76, 1.133; 490-496, 1.055; 554-568, 1.178; 500-506, 1.046; 545-551, 1.071; 120-128, 1.127; 354-361, 1.134; 174-182, 1.075; 298-304, 1.052; 154-160, 1.084; 189-205, 1.127; 25-31, 1.047; | TRY_PHOSPHO_SITE 182-189; PKC_PHOSPHO_SITE 463-465; PKC_PHOSPHO_SITE 167-169; MYRISTYL 459-464; MYRISTYL 530-535; CK2_PHOSPHO_SITE 46-49; CAMP_PHOSPHO_SITE 65-68; CK2_PHOSPHO_SITE 295-298; CK2_PHOSPHO_SITE 106-109; PKC_PHOSPHO_SITE 241-243; MYRISTYL 524-529; PKC_PHOSPHO_SITE 371-373; MYRISTYL 506-511; CK2_PHOSPHO_SITE 549-552; CK2_PHOSPHO_SITE 12-15; CK2_PHOSPHO_SITE 463-466; CK2_PHOSPHO_SITE 13-16; ASN_GLYCOSYLATION 2-5; CK2_PHOSPHO_SITE 185-188; MYRISTYL 26-31; PKC_PHOSPHO_SITE 384-386; CK2_PHOSPHO_SITE 574-577; CK2_PHOSPHO_SITE 282-285; PKC_PHOSPHO_SITE 260-262; PKC_PHOSPHO_SITE 178-180; CK2_PHOSPHO_SITE 74-77; ASN_GLYCOSYLATION 231-234; MYRISTYL 79-84; PKC_PHOSPHO_SITE 68-70; CK2_PHOSPHO_SITE 260-263; PKC_PHOSPHO_SITE 33-35; ASN_GLYCOSYLATION 366-369; CK2_PHOSPHO_SITE 214-217; MYRISTYL 103-108; CK2_PHOSPHO_SITE 565-568; AMIDATION 163-166; CK2_PHOSPHO_SITE 269-272; | PRO_RICH 407-449; SH3 351-410; SH3DOMAIN 368-383; SH3 354-409; sp_Q9GZQ2_Q9GZQ2_HUMAN 360-403; SH3DOMAIN 354-364; SH3DOMAIN 396-408; SH3 354-408; |
| DEX0455_051.aa.2 | N | 0 - o1-408; | 4-41, 1.232; 67-83, 1.127; 205-212, 1.141; 306-321, 1.091; 117-136, 1.127; | PKC_PHOSPHO_SITE 401-403; CK2_PHOSPHO_SITE 341-344; CK2_PHOSPHO_SITE 63-66; ASN_GLYCOSYLATION 109-112; PKC_PHOSPHO_SITE 56-58; PKC_PHOSPHO_SITE 138-140; PKC_PHOSPHO_SITE 249-251; AMIDATION 401-404; PKC_PHOSPHO_SITE 119-121; | SH3DOMAIN 274-286; SH3DOMAIN 246-261; SH3 232-286; PRICHEXTENSN 165-182; PRICHEXTENSN 50-62; PRO_RICH 285-327; |

-continued

| DEX ID | Sig P | TMHMM | Antigenicity | PTM | Domains |
|---|---|---|---|---|---|
| | | | 232-239, 1.134; 368-374, 1.055; 93-108, 1.13; 275-300, 1.135; 176-182, 1.052; 348-355, 1.104; 387-397, 1.077; 247-261, 1.122; 45-60, 1.079; 378-384, 1.046; | PKC_PHOSPHO_SITE 262-264; CK2_PHOSPHO_SITE 138-141; ASN_GLYCOSYLATION 244-247; CK2_PHOSPHO_SITE 147-150; MYRISTYL 384-389; CK2_PHOSPHO_SITE 92-95; PKC_PHOSPHO_SITE 341-343; MYRISTYL 337-342; TYR_PHOSPHO_SITE 60-67; CK2_PHOSPHO_SITE 160-163; CK2_PHOSPHO_SITE 173-176; | sp_Q9GZQ2_Q9GZQ2_HUMAN 238-281; SH3 229-288; SH3 232-287; SH3DOMAIN 232-242; PRICHEXTENSN 308-320; |
| DEX0455_051.aa.3 | N | 0 - o1-470; | 383-393, 1.077; 428-442, 1.178; 344-351, 1.104; 374-380, 1.046; 4-37, 1.232; 41-56, 1.079; 271-296, 1.135; 447-453, 1.113; 419-425, 1.071; 243-257, 1.122; 113-132, 1.127; 228-235, 1.134; 302-317, 1.091; 172-178, 1.052; 201-208, 1.141; 89-104, 1.13; 63-79, 1.127; 397-414, 1.153; 364-370, 1.055; | CK2_PHOSPHO_SITE 88-91; CK2_PHOSPHO_SITE 423-426; PKC_PHOSPHO_SITE 258-260; CK2_PHOSPHO_SITE 156-159; CK2_PHOSPHO_SITE 169-172; CK2_PHOSPHO_SITE 59-62; CK2_PHOSPHO_SITE 143-146; MYRISTYL 380-385; CK2_PHOSPHO_SITE 134-137; CK2_PHOSPHO_SITE 448-451; ASN_GLYCOSYLATION 105-108; PKC_PHOSPHO_SITE 134-136; PKC_PHOSPHO_SITE 52-54; CK2_PHOSPHO_SITE 439-442; CK2_PHOSPHO_SITE 337-340; PKC_PHOSPHO_SITE 115-117; MYRISTYL 398-403; PKC_PHOSPHO_SITE 337-339; MYRISTYL 404-409; TYR_PHOSPHO_SITE 56-63; ASN_GLYCOSYLATION 240-243; PKC_PHOSPHO_SITE 245-247; MYRISTYL 333-338; | sp_Q9GZQ2_Q9GZQ2_HUMAN 234-277; SH3 228-283; PRICHEXTENSN 304-316; SH3DOMAIN 228-238; PRO_RICH 281-323; SH3 225-284; PRICHEXTENSN 46-58; SH3DOMAIN 270-282; SH3DOMAIN 242-257; SH3 228-282; PRICHEXTENSN 161-178; |
| DEX0455_051.orf.4 | N | 0 - o1-474; | 378-384, 1.046; 45-60, 1.079; 306-321, 1.091; 176-182, 1.052; 67-83, 1.127; 232-239, 1.134; 247-261, 1.122; 93-108, 1.13; 432-446, 1.178; 117-136, 1.127; 451-457, 1.113; 205-212, 1.141; 4-41, 1.232; 348-355, 1.104; | PKC_PHOSPHO_SITE 341-343; PKC_PHOSPHO_SITE 262-264; CK2_PHOSPHO_SITE 173-176; PKC_PHOSPHO_SITE 119-121; CK2_PHOSPHO_SITE 63-66; CK2_PHOSPHO_SITE 138-141; CK2_PHOSPHO_SITE 160-163; CK2_PHOSPHO_SITE 452-455; MYRISTYL 384-389; PKC_PHOSPHO_SITE 138-140; ASN_GLYCOSYLATION 109-112; CK2_PHOSPHO_SITE 427-430; TYR_PHOSPHO_SITE 60-67; PKC_PHOSPHO_SITE 249-251; CK2_PHOSPHO_SITE 341-344; MYRISTYL 402-407; CK2_PHOSPHO_SITE 147-150; MYRISTYL 408-413; CK2_PHOSPHO_SITE 443-446; PKC_PHOSPHO_SITE 56-58; MYRISTYL 337-342; CK2_PHOSPHO_SITE 92-95; ASN_GLYCOSYLATION 244-247; | PRO_RICH 285-327; SH3 229-288; PRICHEXTENSN 165-182; SH3DOMAIN 274-286; SH3DOMAIN 246-261; SH3DOMAIN 232-242; PRICHEXTENSN 308-320; PRICHEXTENSN 50-62; sp_Q9GZQ2_Q9GZQ2_HUMAN 238-281; SH3 232-287; SH3 232-286; |

-continued

| DEX ID | Sig P | TMHMM | Antigenicity | PTM | Domains |
|---|---|---|---|---|---|
| | | | 275-300, 1.135; 387-397, 1.077; 368-374, 1.055; 423-429, 1.071; 401-418, 1.153; | | |
| DEX0455_051.orf.5 | N | 0 - o1-474; | 306-321, 1.091; 93-108, 1.13; 232-239, 1.134; 423-429, 1.071; 451-457, 1.113; 247-261, 1.122; 432-446, 1.178; 348-355, 1.104; 401-418, 1.153; 368-374, 1.055; 45-60, 1.079; 275-300, 1.135; 387-397, 1.077; 205-212, 1.141; 176-182, 1.052; 378-384, 1.046; 117-136, 1.127; 67-83, 1.127; 4-41, 1.232; | ASN_GLYCOSYLATION 244-247; PKC_PHOSPHO_SITE 249-251; CK2_PHOSPHO_SITE 341-344; CK2_PHOSPHO_SITE 443-446; MYRISTYL 402-407; PKC_PHOSPHO_SITE 119-121; PKC_PHOSPHO_SITE 56-58; CK2_PHOSPHO_SITE 160-163; PKC_PHOSPHO_SITE 138-140; CK2_PHOSPHO_SITE 63-66; MYRISTYL 337-342; TYR_PHOSPHO_SITE 60-67; CK2_PHOSPHO_SITE 92-95; CK2_PHOSPHO_SITE 173-176; MYRISTYL 408-413; ASN_GLYCOSYLATION 109-112; MYRISTYL 384-389; CK2_PHOSPHO_SITE 427-430; CK2_PHOSPHO_SITE 452-455; CK2_PHOSPHO_SITE 138-141; PKC_PHOSPHO_SITE 341-343; CK2_PHOSPHO_SITE 147-150; PKC_PHOSPHO_SITE 262-264; | PRO_RICH 285-327; SH3 232-287; PRICHEXTENSN 308-320; SH3DOMAIN 246-261; SH3DOMAIN 232-242; PRICHEXTENSN 165-182; SH3 232-286; PRICHEXTENSN 50-62; sp_Q9GZQ2_Q9GZQ2_HUMAN 238-281; SH3DOMAIN 274-286; SH3 229-288; |
| DEX0455_051.orf.6 | N | 0 - o1-474; | 368-374, 1.055; 205-212, 1.141; 348-355, 1.104; 93-108, 1.13; 275-300, 1.135; 45-60, 1.079; 176-182, 1.052; 401-418, 1.153; 378-384, 1.046; 67-83, 1.127; 117-136, 1.127; 387-397, 1.077; 4-41, 1.232; 232-239, 1.134; 306-321, 1.091; 423-429, 1.071; 432-446, 1.178; 451-457, 1.113; | CK2_PHOSPHO_SITE 443-446; CK2_PHOSPHO_SITE 452-455; PKC_PHOSPHO_SITE 56-58; MYRISTYL 408-413; CK2_PHOSPHO_SITE 63-66; MYRISTYL 402-407; CK2_PHOSPHO_SITE 147-150; MYRISTYL 384-389; TYR_PHOSPHO_SITE 60-67; ASN_GLYCOSYLATION 109-112; MYRISTYL 337-342; CK2_PHOSPHO_SITE 138-141; CK2_PHOSPHO_SITE 92-95; PKC_PHOSPHO_SITE 119-121; CK2_PHOSPHO_SITE 173-176; ASN_GLYCOSYLATION 244-247; PKC_PHOSPHO_SITE 249-251; CK2_PHOSPHO_SITE 160-163; PKC_PHOSPHO_SITE 138-140; PKC_PHOSPHO_SITE 341-343; PKC_PHOSPHO_SITE 262-264; CK2_PHOSPHO_SITE 341-344; CK2_PHOSPHO_SITE 427-430; | SH3 229-288; SH3DOMAIN 232-242; SH3DOMAIN 246-261; PRICHEXTENSN 308-320; sp_Q9GZQ2_Q9GZQ2_HUMAN 238-281; PRICHEXTENSN 50-62; PRICHEXTENSN 165-182; SH3 232-286; SH3DOMAIN 274-286; PRO_RICH 285-327; SH3 232-287; |

-continued

| DEX ID | Sig P | TMHMM | Antigenicity | PTM | Domains |
|---|---|---|---|---|---|
| DEX0455_052.aa.1 | N | 0 - o1-470; | 247-261, 1.122; 63-79, 1.127; 271-296, 1.135; 383-393, 1.077; 243-257, 1.122; 4-37, 1.232; 89-104, 1.13; 374-380, 1.046; 41-56, 1.079; 397-414, 1.153; 364-370, 1.055; 419-425, 1.071; 302-317, 1.091; 172-178, 1.052; 447-453, 1.113; 228-235, 1.134; 344-351, 1.104, 201-208, 1.141; 113-132, 1.127; 428-442, 1.178; | PKC_PHOSPHO_SITE 258-260; CK2_PHOSPHO_SITE 423-426; CK2_PHOSPHO_SITE 59-62; PKC_PHOSPHO_SITE 245-247; PKC_PHOSPHO_SITE 52-54; CK2_PHOSPHO_SITE 143-146; CK2_PHOSPHO_SITE 134-137; CK2_PHOSPHO_SITE 88-91; PKC_PHOSPHO_SITE 134-136; ASN_GLYCOSYLATION 105-108; PKC_PHOSPHO_SITE 337-339; MYRISTYL 398-403; ASN_GLYCOSYLATION 240-243; TYR_PHOSPHO_SITE 56-63; MYRISTYL 333-338; CK2_PHOSPHO_SITE 439-442; MYRISTYL 380-385; PKC_PHOSPHO_SITE 115-117; CK2_PHOSPHO_SITE 337-340; CK2_PHOSPHO_SITE 448-451; MYRISTYL 404-409; CK2_PHOSPHO_SITE 169-172; CK2_PHOSPHO_SITE 156-159; | PRO_RICH 281-323; PRICHEXTENSN 161-178; SH3 228-283; PRICHEXTENSN 304-316; SH3DOMAIN 270-282; SH3DOMAIN 242-257; SH3 228-282; SH3DOMAIN 228-238; PRICHEXTENSN 46-58; SH3 225-284; sp_Q9GZQ2_Q9GZQ2_HUMAN 234-277; |
| DEX0455_052.aa.2 | N | 0 - o1-502; | 479-485, 1.113; 260-267, 1.134; 223-240, 1.141; 406-412, 1.046; 303-328, 1.135; 376-383, 1.104; 451-457, 1.071; 415-425, 1.077; 275-289, 1.122; 4-37, 1.232; 334-349, 1.091; 63-79, 1.127; 113-132, 1.127; 396-402, 1.055; 172-178, 1.052; 429-446, 1.153; 89-104, 1.13; 460-474, 1.178; 41-56, 1.079; | CK2_PHOSPHO_SITE 156-159; CK2_PHOSPHO_SITE 455-458; CK2_PHOSPHO_SITE 59-62; CK2_PHOSPHO_SITE 134-137; PKC_PHOSPHO_SITE 290-292; CK2_PHOSPHO_SITE 369-372; MYRISTYL 365-370; ASN_GLYCOSYLATION 105-108; ASN_GLYCOSYLATION 272-275; TYR_PHOSPHO_SITE 56-63; PKC_PHOSPHO_SITE 277-279; CK2_PHOSPHO_SITE 88-91; PKC_PHOSPHO_SITE 52-54; CK2_PHOSPHO_SITE 143-146; PKC_PHOSPHO_SITE 115-117; MYRISTYL 412-417; MYRISTYL 430-435; PKC_PHOSPHO_SITE 134-136; CK2_PHOSPHO_SITE 169-172; MYRISTYL 436-441; CK2_PHOSPHO_SITE 471-474; CK2_PHOSPHO_SITE 480-483; PKC_PHOSPHO_SITE 369-371; | SH3DOMAIN 302-314; sp_Q9GZQ2_Q9GZQ2_HUMAN 266-309; SH3DOMAIN 274-289; SH3 257-316; SH3 260-314; SH3 260-315; SH3DOMAIN 260-270; PRO_RICH 313-355; |
| DEX0455_052.aa.3 | Y | 0 - o1-548; | 4-29, 1.211; 79-95, 1.162; 56-73, 1.118; | PKC_PHOSPHO_SITE 512-514; MYRISTYL 135-140; ASN_GLYCOSYLATION 340-343; MYRISTYL 188-193; PKC_PHOSPHO_SITE 41-43; | |

-continued

| DEX ID | Sig P | TMHMM | Antigenicity | PTM | Domains |
|---|---|---|---|---|---|
| | | | 495-502, 1.134; 510-519, 1.1; 167-185, 1.133; 239-258, 1.131; 263-269, 1.084; 99-109, 1.259; 208-214, 1.045; 407-413, 1.052; 298-314, 1.127; 134-140, 1.047; 324-339, 1.13; 42-48, 1.082; 149-154, 1.041; 348-367, 1.127; 525-531, 1.113; 283-291, 1.075; 113-127, 1.116; 458-475, 1.141; 229-237, 1.127; | CK2_PHOSPHO_SITE 36-39; CK2_PHOSPHO_SITE 391-394; PKC_PHOSPHO_SITE 350-352; AMIDATION 1-4; CK2_PHOSPHO_SITE 294-297; PKC_PHOSPHO_SITE 276-278; MYRISTYL 212-217; CK2_PHOSPHO_SITE 183-186; PKC_PHOSPHO_SITE 287-289; ASN_GLYCOSYLATION 12-15; PKC_PHOSPHO_SITE 369-371; CK2_PHOSPHO_SITE 74-77; CK2_PHOSPHO_SITE 323-326; CK2_PHOSPHO_SITE 369-372; CAMP_PHOSPHO_SITE 174-177; CK2_PHOSPHO_SITE 68-71; TYR_PHOSPHO_SITE 291-298; AMIDATION 272-275; CK2_PHOSPHO_SITE 404-407; PKC_PHOSPHO_SITE 177-179; CK2_PHOSPHO_SITE 155-158; CK2_PHOSPHO_SITE 215-218; ASN_GLYCOSYLATION 507-510; CK2_PHOSPHO_SITE 526-529; CK2_PHOSPHO_SITE 378-381; PKC_PHOSPHO_SITE 142-144; MYRISTYL 121-126; | |
| DEX0455_052.aa.4 | Y | 0 - o1-277; | 78-103, 1.135; 109-124, 1.091; 235-249, 1.178; 254-260, 1.113; 4-19, 1.169; 151-158, 1.104; 181-187, 1.046; 204-221, 1.153; 190-200, 1.077; 50-64, 1.122; 226-232, 1.071; 35-42, 1.134; 171-177, 1.055; | MYRISTYL 2-7; PKC_PHOSPHO_SITE 16-18; CK2_PHOSPHO_SITE 230-233; MYRISTYL 211-216; CK2_PHOSPHO_SITE 246-249; MYRISTYL 205-210; CK2_PHOSPHO_SITE 255-258; CK2_PHOSPHO_SITE 144-147; PKC_PHOSPHO_SITE 65-67; MYRISTYL 140-145; PKC_PHOSPHO_SITE 144-146; ASN_GLYCOSYLATION 47-50; CK2_PHOSPHO_SITE 16-19; PKC_PHOSPHO_SITE 52-54; MYRISTYL 187-192; | SH3DOMAIN 77-89; PRICHEXTENSN 170-195; PRICHEXTENSN 112-128; SH3 35-89; PRICHEXTENSN 88-109; PRO_RICH 88-130; SH3 32-91; SH3DOMAIN 35-45; SH3 35-90; sp_Q9GZQ2_Q9GZQ2_HUMAN 41-84; SH3DOMAIN 49-64; |
| DEX0455_053.aa.1 | Y | 1 - i1-6; tm7-29; o30-282; | 73-83, 1.16; 36-45, 1.103; 152-160, 1.069; 176-186, 1.162; 127-134, 1.125; 207-217, 1.215; 53-59, 1.066; 61-71, 1.119; 248-279, 1.179; 100-123, 1.136; | ASN_GLYCOSYLATION 112-115; CK2_PHOSPHO_SITE 91-94; ASN_GLYCOSYLATION 216-219; CK2_PHOSPHO_SITE 151-154; CAMP_PHOSPHO_SITE 246-249; ASN_GLYCOSYLATION 196-199; PKC_PHOSPHO_SITE 32-34; MYRISTYL 188-193; CK2_PHOSPHO_SITE 183-186; PKC_PHOSPHO_SITE 207-209; ASN_GLYCOSYLATION 190-193; ASN_GLYCOSYLATION 160-163; MYRISTYL 52-57; PKC_PHOSPHO_SITE 127-129; ASN_GLYCOSYLATION 205-208; CK2_PHOSPHO_SITE 241-244; PKC_PHOSPHO_SITE 134-136; CK2_PHOSPHO_SITE 197-200; | IG_LIKE_2 153-241; IG_LIKE_1 49-151; |

| DEX ID | Sig P | TMHMM | Antigenicity | PTM | Domains |
|---|---|---|---|---|---|
| | | | 165-171, 1.06; 4-30, 1.146; | PKC_PHOSPHO_SITE 165-167; PKC_PHOSPHO_SITE 114-116; ASN_GLYCOSYLATION 220-223; MYRISTYL 126-131; | |
| DEX0455_053.aa.2 | Y | 1 - i1-6; tm7-29; o30-59; | 4-39, 1.146; 41-56, 1.17; | | |
| DEX0455_053.aa.3 | N | 0 - o1-252; | 177-187, 1.215; 43-53, 1.16; 23-29, 1.1; 122-130, 1.069; 146-156, 1.162; 218-249, 1.179; 6-15, 1.103; 70-93, 1.136; 97-104, 1.125; 135-141, 1.06; 31-41, 1.119; | ASN_GLYCOSYLATION 166-169; PKC_PHOSPHO_SITE 177-179; PKC_PHOSPHO_SITE 97-99; CK2_PHOSPHO_SITE 153-156; PKC_PHOSPHO_SITE 104-106; ASN_GLYCOSYLATION 160-163; CK2_PHOSPHO_SITE 167-170; ASN_GLYCOSYLATION 186-189; CAMP_PHOSPHO_SITE 216-219; CK2_PHOSPHO_SITE 61-64; ASN_GLYCOSYLATION 82-85; CK2_PHOSPHO_SITE 121-124; PKC_PHOSPHO_SITE 84-86; CK2_PHOSPHO_SITE 211-214; ASN_GLYCOSYLATION 190-193; MYRISTYL 158-163; ASN_GLYCOSYLATION 130-133; MYRISTYL 96-101; MYRISTYL 22-27; PKC_PHOSPHO_SITE 135-137; ASN_GLYCOSYLATION 175-178; | IG_LIKE_1 19-121; ig 19-102; IG 11-116; IG_LIKE_2 123-211; |
| DEX0455_054.orf.1 | N | 0 - o1-155; | 6-13, 1.134; 145-152, 1.23; 34-51, 1.251; 53-87, 1.163; 21-30, 1.088; 99-123, 1.205; | CK2_PHOSPHO_SITE 72-75; PKC_PHOSPHO_SITE 67-69; AMIDATION 124-127; MYRISTYL 109-114; MYRISTYL 79-84; CK2_PHOSPHO_SITE 89-92; | PRO_RICH 51-70; |
| DEX0455_054.aa.1 | N | 0 - o1-107; | 23-31, 1.113; 4-20, 1.19; 61-67, 1.089; 36-57, 1.184; 81-90, 1.191; | PKC_PHOSPHO_SITE 100-102; MYRISTYL 94-99; PKC_PHOSPHO_SITE 35-37; | sp_P14786_KPY2_HUMAN 12-105; PK_C 3-105; |
| DEX0455_054.orf.2 | N | 0 - o1-155; | 99-123, 1.205; 6-13, 1.134; 53-87, 1.163; 145-152, 1.23; 34-51, 1.251; 21-30, 1.088; | AMIDATION 124-127; CK2_PHOSPHO_SITE 89-92; MYRISTYL 79-84; PKC_PHOSPHO_SITE 67-69; MYRISTYL 109-114; CK2_PHOSPHO_SITE 72-75; | PRO_RICH 51-70; |
| DEX0455_054.aa.2 | N | 0 - o1-143; | 28-45, 1.179; 72-93, 1.184; 50-56, 1.095; 117-126, 1.191; 7-14, 1.1; 97-103, 1.089; 59-67, 1.113; | MYRISTYL 27-32; PKC_PHOSPHO_SITE 32-34; PKC_PHOSPHO_SITE 136-138; PKC_PHOSPHO_SITE 71-73; MYRISTYL 130-135; PKC_PHOSPHO_SITE 46-48; | PK_C 21-141; sp_P11974_KPY1_RABIT 1-141; |
| DEX0455_055.aa.1 | N | 0 - o1-253; | | MYRISTYL 52-57; CK2_PHOSPHO_SITE 11-14; PKC_PHOSPHO_SITE 19-21; PKC_PHOSPHO_SITE 207-209; CK2_PHOSPHO_SITE 9-12; PKC_PHOSPHO_SITE 164-166; CK2_PHOSPHO_SITE 7-10; CAMP_PHOSPHO_SITE 131-134; PKC_PHOSPHO_SITE 130-132; PKC_PHOSPHO_SITE 245-247; | |

-continued

| DEX ID | Sig P | TMHMM | Antigenicity | PTM | Domains |
|---|---|---|---|---|---|
| DEX0455_055.aa.2 | N | 0 - o1-361; | 107-114, 1.114; 42-52, 1.147; 83-97, 1.14; 70-76, 1.055; 236-242, 1.115; 4-11, 1.148; 320-326, 1.056; 164-186, 1.208; 124-135, 1.132; 273-278, 1.03; 99-105, 1.047; 224-230, 1.064; | CK2_PHOSPHO_SITE 243-246; AMIDATION 176-179; CK2_PHOSPHO_SITE 19-22; CAMP_PHOSPHO_SITE 18-21; CK2_PHOSPHO_SITE 12-15; AMIDATION 348-351; MYRISTYL 107-112; PKC_PHOSPHO_SITE 344-346; CAMP_PHOSPHO_SITE 186-189; MYRISTYL 311-316; CAMP_PHOSPHO_SITE 309-312; PKC_PHOSPHO_SITE 325-327; AMIDATION 231-234; CK2_PHOSPHO_SITE 62-65; MYRISTYL 22-27; CK2_PHOSPHO_SITE 66-69; ASN_GLYCOSYLATION 358-361; PKC_PHOSPHO_SITE 262-264; AMIDATION 306-309; PKC_PHOSPHO_SITE 16-18; CK2_PHOSPHO_SITE 74-77; PKC_PHOSPHO_SITE 185-187; PKC_PHOSPHO_SITE 219-221; PKC_PHOSPHO_SITE 74-76; CK2_PHOSPHO_SITE 319-322; AMIDATION 339-342; CK2_PHOSPHO_SITE 64-67; CAMP_PHOSPHO_SITE 341-344; PKC_PHOSPHO_SITE 293-295; | |
| DEX0455_055.aa.3 | N | 0 - i1-167; | 28-49, 1.115; 126-137, 1.056; 68-84, 1.038; 4-10, 1.009; 12-19, 1.035; 60-66, 1.026; | AMIDATION 112-115; MYRISTYL 117-122; PKC_PHOSPHO_SITE 25-27; PKC_PHOSPHO_SITE 131-133; PKC_PHOSPHO_SITE 150-152; AMIDATION 145-148; CAMP_PHOSPHO_SITE 147-150; CK2_PHOSPHO_SITE 125-128; PKC_PHOSPHO_SITE 99-101; AMIDATION 37-40; CAMP_PHOSPHO_SITE 115-118; AMIDATION 154-157; PKC_PHOSPHO_SITE 68-70; ASN_GLYCOSYLATION 164-167; | |
| DEX0455_056.orf.1 | N | 0 - o1-636; | 53-59, 1.147; 401-411, 1.092; 4-10, 1.067; 592-633, 1.179; 218-253, 1.106; 474-480, 1.058; 95-136, 1.207; 440-448, 1.082; 354-372, 1.185; 165-203, 1.177; 66-74, 1.083; 429-437, 1.111; 142-148, 1.091; 153-163, 1.075; 274-285, 1.132; 374-386, 1.187; 578-584, 1.107; 530-574, 1.129; | ASN_GLYCOSYLATION 199-202; MYRISTYL 65-70; MYRISTYL 451-456; CK2_PHOSPHO_SITE 221-224; ASN_GLYCOSYLATION 454-457; CK2_PHOSPHO_SITE 574-577; CK2_PHOSPHO_SITE 115-118; MYRISTYL 531-536; CK2_PHOSPHO_SITE 347-350; CK2_PHOSPHO_SITE 137-140; CK2_PHOSPHO_SITE 308-311; CK2_PHOSPHO_SITE 301-304; MYRISTYL 336-341; MYRISTYL 154-159; PKC_PHOSPHO_SITE 201-203; MYRISTYL 231-236; CK2_PHOSPHO_SITE 525-528; ASN_GLYCOSYLATION 415-418; MYRISTYL 206-211; PKC_PHOSPHO_SITE 565-567; PKC_PHOSPHO_SITE 286-288; TYR_PHOSPHO_SITE 351-357; MYRISTYL 60-65; TYR_PHOSPHO_SITE 421-428; AMIDATION 20-23; CK2_PHOSPHO_SITE 70-73; MYRISTYL 63-68; PKC_PHOSPHO_SITE 70-72; CK2_PHOSPHO_SITE 293-296; MYRISTYL 588-593; MYRISTYL 51-56; CAMP_PHOSPHO_SITE 23-26; ASN_GLYCOSYLATION 548-551; CK2_PHOSPHO_SITE 35-38; MYRISTYL 4-9; MYRISTYL 11-16; | |

-continued

| DEX ID | Sig P | TMHMM | Antigenicity | PTM | Domains |
|---|---|---|---|---|---|
| | | | 460-466, 1.147; 76-83, 1.118; 490-518, 1.111; 259-265, 1.052; 290-302, 1.163; 309-325, 1.128; | CK2_PHOSPHO_SITE 235-238; CK2_PHOSPHO_SITE 286-289; MYRISTYL 49-54; | |
| DEX0455_056.aa.1 | N | 0 - o1-870; | 38-44, 1.147; 386-396, 1.092; 690-699, 1.137; 679-688, 1.065; 339-357, 1.185; 259-270, 1.132; 634-652, 1.134; 515-559, 1.129; 51-59, 1.083; 425-433, 1.082; 294-310, 1.128; 445-451, 1.147; 275-287, 1.163; 244-250, 1.052; 763-796, 1.144; 459-465, 1.058; 827-844, 1.127; 150-188, 1.177; 414-422, 1.111; 739-754, 1.163; 659-664, 1.038; 707-723, 1.101; 359-371, 1.187; 798-805, 1.037; 203-238, 1.106; 80-121, 1.207; 563-569, 1.107; 851-867, 1.148; 577-629, 1.179; 475-503, 1.111; 127-133, 1.091; 138-148, 1.075; 61-68, 1.118; 666-676, 1.164; | CK2_PHOSPHO_SITE 559-562; CK2_PHOSPHO_SITE 122-125; MYRISTYL 659-664; MYRISTYL 36-41; MYRISTYL 34-39; PKC_PHOSPHO_SITE 271-273; CK2_PHOSPHO_SITE 510-513; MYRISTYL 45-50; TYR_PHOSPHO_SITE 406-413; CK2_PHOSPHO_SITE 206-209; MYRISTYL 834-839; PKC_PHOSPHO_SITE 664-666; CK2_PHOSPHO_SITE 332-335; ASN_GLYCOSYLATION 533-536; MYRISTYL 436-441; MYRISTYL 139-144; MYRISTYL 191-196; MYRISTYL 573-578; PKC_PHOSPHO_SITE 550-552; CK2_PHOSPHO_SITE 220-223; PKC_PHOSPHO_SITE 762-764; CK2_PHOSPHO_SITE 100-103; CK2_PHOSPHO_SITE 824-827; CK2_PHOSPHO_SITE 640-643; MYRISTYL 321-326; PKC_PHOSPHO_SITE 55-57; PKC_PHOSPHO_SITE 186-188; CK2_PHOSPHO_SITE 20-23; CK2_PHOSPHO_SITE 286-289; MYRISTYL 216-221; CK2_PHOSPHO_SITE 278-281; PKC_PHOSPHO_SITE 842-844; ASN_GLYCOSYLATION 184-187; CAMP_PHOSPHO_SITE 748-751; MYRISTYL 516-521; MYRISTYL 50-55; TYR_PHOSPHO_SITE 336-342; PKC_PHOSPHO_SITE 756-758; ASN_GLYCOSYLATION 439-442; ASN_GLYCOSYLATION 400-403; AMIDATION 5-8; PKC_PHOSPHO_SITE 824-826; CAMP_PHOSPHO_SITE 8-11; CK2_PHOSPHO_SITE 293-296; CK2_PHOSPHO_SITE 55-58; CK2_PHOSPHO_SITE 271-274; MYRISTYL 48-53; | |

-continued

| DEX ID | Sig P | TMHMM | Antigenicity | PTM | Domains |
|---|---|---|---|---|---|
| DEX0455_056.aa.2 | N | 0 - o1-791; | 244-250, 1.052; 51-59, 1.083; 339-357, 1.185; 577-619, 1.179; 772-788, 1.148; 669-678, 1.065; 138-148, 1.075; 656-666, 1.164; 294-310, 1.128; 475-503, 1.111; 515-559, 1.129; 459-465, 1.058; 697-713, 1.101; 386-396, 1.092; 624-642, 1.134; 445-451, 1.147; 127-133, 1.091; 680-689, 1.137; 38-44, 1.147; 359-371, 1.187; 259-270, 1.132; 414-422, 1.111; 563-569, 1.107; 753-765, 1.127; 203-238, 1.106; 425-433, 1.082; 729-744, 1.163; 275-287, 1.163; 150-188, 1.177; 80-121, 1.207; 61-68, 1.118; 649-654, 1.038; | CAMP_PHOSPHO_SITE 738-741; PKC_PHOSPHO_SITE 55-57; CK2_PHOSPHO_SITE 220-223; CK2_PHOSPHO_SITE 100-103; CK2_PHOSPHO_SITE 122-125; CK2_PHOSPHO_SITE 271-274; CK2_PHOSPHO_SITE 286-289; CAMP_PHOSPHO_SITE 8-11; PKC_PHOSPHO_SITE 654-656; MYRISTYL 191-196; MYRISTYL 516-521; CK2_PHOSPHO_SITE 510-513; MYRISTYL 36-41; PKC_PHOSPHO_SITE 763-765; CK2_PHOSPHO_SITE 630-633; MYRISTYL 321-326; CK2_PHOSPHO_SITE 332-335; PKC_PHOSPHO_SITE 271-273; MYRISTYL 216-221; PKC_PHOSPHO_SITE 186-188; CK2_PHOSPHO_SITE 293-296; MYRISTYL 139-144; ASN_GLYCOSYLATION 439-442; MYRISTYL 573-578; AMIDATION 5-8; MYRISTYL 50-55; PKC_PHOSPHO_SITE 752-754; PKC_PHOSPHO_SITE 550-552; ASN_GLYCOSYLATION 533-536; TYR_PHOSPHO_SITE 406-413; MYRISTYL 48-53; PKC_PHOSPHO_SITE 746-748; CK2_PHOSPHO_SITE 559-562; ASN_GLYCOSYLATION 400-403; MYRISTYL 34-39; MYRISTYL 436-441; CK2_PHOSPHO_SITE 278-281; CK2_PHOSPHO_SITE 206-209; MYRISTYL 649-654; CK2_PHOSPHO_SITE 20-23; ASN_GLYCOSYLATION 184-187; TYR_PHOSPHO_SITE 336-342; MYRISTYL 755-760; CK2_PHOSPHO_SITE 55-58; MYRISTYL 45-50; | |
| DEX0455_057.orf.1 | N | 0 - o1-122; | 97-119, 1.114; 30-41, 1.138; 4-13, 1.125; | PKC_PHOSPHO_SITE 3-5; ASN_GLYCOSYLATION 48-51; CK2_PHOSPHO_SITE 25-28; PKC_PHOSPHO_SITE 27-29; CK2_PHOSPHO_SITE 23-26; PKC_PHOSPHO_SITE 118-120; MYRISTYL 103-108; CK2_PHOSPHO_SITE 12-15; CK2_PHOSPHO_SITE 86-89; CK2_PHOSPHO_SITE 52-55; | EF_HAND_2 25-101; S100_CABP 80-101; EFh 76-104; sp_P31949_S111_HUMAN 25-94; S_100 27-70; efhand 76-104; sp_O93395_O93395_SALFO 44-98; EF_HAND 85-97; |
| DEX0455_057.aa.1 | N | 0 - o1-170; | 78-89, 1.138; 145-167, 1.114; 4-38, 1.16; | ASN_GLYCOSYLATION 96-99; CK2_PHOSPHO_SITE 71-74; PKC_PHOSPHO_SITE 55-57; CK2_PHOSPHO_SITE 43-46; PKC_PHOSPHO_SITE 75-77; CK2_PHOSPHO_SITE 134-137; PKC_PHOSPHO_SITE 166-168; | sp_P31949_S111_HUMAN 73-142; EF_HAND 133-145; S100_CABP 128-149; sp_O93395_O93395_SALFO 92-146; |

-continued

| DEX ID | Sig P | TMHMM | Antigenicity | PTM | Domains |
|---|---|---|---|---|---|
| | | | | CK2_PHOSPHO_SITE 100-103; MYRISTYL 151-156; CK2_PHOSPHO_SITE 73-76; PKC_PHOSPHO_SITE 58-60; CK2_PHOSPHO_SITE 6-9; | efhand 124-152; EFh 124-152; S_100 75-118; EF_HAND_2 73-149; |
| DEX0455_057.aa.2 | N | 0 - o1-91; | 66-88, 1.114; 4-11, 1.134; | CK2_PHOSPHO_SITE 55-58; ASN_GLYCOSYLATION 17-20; PKC_PHOSPHO_SITE 87-89; CK2_PHOSPHO_SITE 21-24; MYRISTYL 72-77; | EFh 45-73; efhand 45-73; S100_CABP 49-70; S_100 3-39; EF_HAND 54-66; sp_P31949_S1I1_HUMAN 9-63; EF_HAND_2 19-70; sp_O93395_O93395_SALFO 13-67; |
| DEX0455_058.orf.1 | N | 1 —o1-14; tm15-37; i38-66; | 4-25, 1.178; 27-63, 1.191; | CK2_PHOSPHO_SITE 23-26; MYRISTYL 27-32; | |
| DEX0455_058.aa.1 | N | 0 - o1-65; | 24-32, 1.155; 36-54, 1.162; 14-22, 1.084; | TYR_PHOSPHO_SITE 12-18; ASN_GLYCOSYLATION 59-62; CK2_PHOSPHO_SITE 6-9; | |
| DEX0455_059.orf.1 | N | 0 - o1-363; | 104-122, 1.145; 261-268, 1.085; 11-21, 1.113; 341-351, 1.191; 125-159, 1.118; 178-212, 1.171; 69-77, 1.128; 315-330, 1.192; 270-275, 1.039; 235-248, 1.131; 281-289, 1.116; 353-360, 1.134; 85-102, 1.157; 295-305, 1.07; 225-232, 1.131; | PKC_PHOSPHO_SITE 80-82; CK2_PHOSPHO_SITE 28-31; PKC_PHOSPHO_SITE 281-283; CAMP_PHOSPHO_SITE 105-108; MYRISTYL 47-52; CAMP_PHOSPHO_SITE 77-80; PKC_PHOSPHO_SITE 103-105; MYRISTYL 335-340; PKC_PHOSPHO_SITE 206-208; PKC_PHOSPHO_SITE 76-78; MYRISTYL 304-309; MYRISTYL 71-76; PKC_PHOSPHO_SITE 28-30; PKC_PHOSPHO_SITE 8-10; CK2_PHOSPHO_SITE 17-20; PKC_PHOSPHO_SITE 62-64; CK2_PHOSPHO_SITE 237-240; | |
| DEX0455_059.aa.1 | N | 0 - o1-116; | 38-67, 1.204; 28-34, 1.111; 12-23, 1.084; 71-113, 1.168; | PKC_PHOSPHO_SITE 25-27; PKC_PHOSPHO_SITE 58-60; AMIDATION 16-19; CK2_PHOSPHO_SITE 5-8; PKC_PHOSPHO_SITE 45-47; | |
| DEX0455_059.orf.2 | N | 0 - o1-166; | 118-133, 1.192; 16-26, 1.124; 98-108, 1.07; 144-154, 1.191; 64-71, 1.085; 7-13, 1.026; 38-51, 1.131; 84-92, 1.116; 28-35, 1.122; 156-163, 1.134; 73-78, 1.039; | MYRISTYL 107-112; CK2_PHOSPHO_SITE 40-43; MYRISTYL 138-143; PKC_PHOSPHO_SITE 84-86; | |
| DEX0455_060.aa.1 | Y | 0 - o1-207; | 115-122, 1.108; 149-187, 1.215; | MYRISTYL 76-81; AMIDATION 79-82; PKC_PHOSPHO_SITE 42-44; MYRISTYL 34-39; MYRISTYL 41-46; | BTG_1 124-144; ANTIPRLFBTG1 173-202; Anti_proliferat |

-continued

| DEX ID | Sig P | TMHMM | Antigenicity | PTM | Domains |
|---|---|---|---|---|---|
| | | | 193-199, 1.122; 4-26, 1.251; 138-145, 1.131; 43-56, 1.102; 87-101, 1.175; | PKC_PHOSPHO_SITE 24-26; MYRISTYL 75-80; | 83-207; BTG_2 170-189; btg1 83-190; ANTIPRLFBTG1 88-112; ANTIPRLFBTG1 113-142; |
| DEX0455_061.aa.1 | N | 0 - o1-352; | 173-179, 1.031; 264-290, 1.129; 181-187, 1.04; 138-148, 1.114; 36-68, 1.256; 4-10, 1.15; 108-113, 1.105; 230-241, 1.187; 120-128, 1.086; 249-257, 1.172; 344-349, 1.095; 14-20, 1.171; 208-225, 1.103; 333-340, 1.068; 81-91, 1.111; 292-319, 1.15; | MYRISTYL 57-62; CK2_PHOSPHO_SITE 22-25; MYRISTYL 133-138; CK2_PHOSPHO_SITE 150-153; PKC_PHOSPHO_SITE 178-180; ASN_GLYCOSYLATION 134-137; MYRISTYL 43-48; AMIDATION 10-13; CAMP_PHOSPHO_SITE 119-122; CK2_PHOSPHO_SITE 314-317; ASN_GLYCOSYLATION 225-228; TYR_PHOSPHO_SITE 263-269; PKC_PHOSPHO_SITE 331-333; CK2_PHOSPHO_SITE 170-173; MYRISTYL 217-222; | RA 203-293; RA_DOMAIN 205-293; RA 203-293; |
| DEX0455_061.aa.2 | N | 0 - o1-261; | 230-241, 1.187; 108-113, 1.105; 173-179, 1.031; 208-225, 1.103; 36-68, 1.256; 81-91, 1.111; 249-258, 1.172; 138-148, 1.114; 120-128, 1.086; 4-10, 1.15; 14-20, 1.171; 181-187, 1.04; | ASN_GLYCOSYLATION 134-137; MYRISTYL 43-48; CAMP_PHOSPHO_SITE 119-122; MYRISTYL 57-62; CK2_PHOSPHO_SITE 150-153; PKC_PHOSPHO_SITE 178-180; AMIDATION 10-13; CK2_PHOSPHO_SITE 22-25; MYRISTYL 217-222; ASN_GLYCOSYLATION 225-228; MYRISTYL 133-138; CK2_PHOSPHO_SITE 170-173; | RA 203-260; RA_DOMAIN 205-261; |
| DEX0455_061.aa.3 | N | 0 - o1-269; | 181-187, 1.04; 36-68, 1.256; 120-128, 1.086; 230-241, 1.187; 14-20, 1.171; 4-10, 1.15; 173-179, 1.031; 108-113, 1.105; 81-91, 1.111; 138-148, 1.114; 208-225, 1.103; 249-257, 1.172; | CK2_PHOSPHO_SITE 22-25; CK2_PHOSPHO_SITE 258-261; MYRISTYL 133-138; CK2_PHOSPHO_SITE 170-173; CK2_PHOSPHO_SITE 150-153; ASN_GLYCOSYLATION 225-228; AMIDATION 10-13; MYRISTYL 217-222; ASN_GLYCOSYLATION 134-137; MYRISTYL 57-62; PKC_PHOSPHO_SITE 178-180; MYRISTYL 43-48; CAMP_PHOSPHO_SITE 119-122; | RA 203-269; RA_DOMAIN 205-269; |

-continued

| DEX ID | Sig P | TMHMM | Antigenicity | PTM | Domains |
|---|---|---|---|---|---|
| DEX0455_061.aa.4 | Y | 0 - o1-133; | 4-31, 1.159; 61-129, 1.207; 41-58, 1.181; | ASN_GLYCOSYLATION 51-54; PKC_PHOSPHO_SITE 77-79; | |
| DEX0455_061.orf.5 | N | 0 - o1-163; | 92-130, 1.205; 56-85, 1.181; 147-160, 1.134; 4-11, 1.118; 32-52, 1.22; | CK2_PHOSPHO_SITE 51-54; MYRISTYL 17-22; PKC_PHOSPHO_SITE 5-7; CK2_PHOSPHO_SITE 47-50; MYRISTYL 143-148; MYRISTYL 144-149; MYRISTYL 139-144; | |
| DEX0455_062.aa.1 | Y | 0 - o1-491; | 395-401, 1.032; 180-196, 1.118; 403-409, 1.077; 121-138, 1.121; 214-232, 1.143; 4-31, 1.234; 431-463, 1.191; 259-269, 1.1; 86-103, 1.07; 292-308, 1.304; 465-481, 1.149; 69-84, 1.2; 159-165, 1.052; 38-61, 1.134; 201-207, 1.072; 275-281, 1.087; 369-375, 1.067; 422-429, 1.117; 316-326, 1.166; 172-178, 1.087; | CK2_PHOSPHO_SITE 22-25; MYRISTYL 140-145; CK2_PHOSPHO_SITE 290-293; CK2_PHOSPHO_SITE 315-318; CK2_PHOSPHO_SITE 343-346; PKC_PHOSPHO_SITE 157-159; MYRISTYL 422-427; CK2_PHOSPHO_SITE 257-260; MYRISTYL 454-459; CK2_PHOSPHO_SITE 405-408; PKC_PHOSPHO_SITE 100-102; CK2_PHOSPHO_SITE 158-161; CK2_PHOSPHO_SITE 248-251; MYRISTYL 401-406; CK2_PHOSPHO_SITE 375-378; MYRISTYL 90-95; PKC_PHOSPHO_SITE 464-466; PKC_PHOSPHO_SITE 106-108; MYRISTYL 116-121; PKC_PHOSPHO_SITE 158-160; MYRISTYL 105-110; PKC_PHOSPHO_SITE 148-150; MYRISTYL 79-84; MYRISTYL 19-24; MYRISTYL 458-463; MYRISTYL 144-149; PKC_PHOSPHO_SITE 239-241; MYRISTYL 7-12; CK2_PHOSPHO_SITE 23-26; | thiored 24-132; THIOREDOXIN 47-65; pdi_dom 165-269; THIOREDOXIN 189-198; THIOREDOXIN 46-54; THIOREDOXIN_2_2 161-284; THIOREDOXIN 233-244; THIOREDOXIN_2_1 26-137; thiored 159-270; pdi_dom 30-131; THIOREDOXIN 182-200; |

Example 1b

Sequence Alignment Support

Alignments between previously identified sequences and splice variant sequences are performed to confirm unique portions of splice variant nucleic acid and amino acid sequences. The alignments are done using the Needle program in the European Molecular Biology Open Software Suite (EMBOSS) version 2.2.0 available at www.emboss.org from EMBnet (http://www.embnet.org). Default settings are used unless otherwise noted. The Needle program in EMBOSS implements the Needleman-Wunsch algorithm. Needleman, S. B., Wunsch, C. D., *J. Mol. Biol.* 48:443-453 (1970).

It is well know to those skilled in the art that implication of alignment algorithms by various programs may result in minor changes in the generated output. These changes include but are not limited to: alignment scores (percent identity, similarity, and gap), display of nonaligned flanking sequence regions, and number assignment to residues. These minor changes in the output of an alignment do not alter the physical characteristics of the sequences or the differences between the sequences, e.g. regions of homology, insertions, or deletions.

Example 1c

RT-PCR Analysis

To detect the presence and tissue distribution of a particular splice variant Reverse Transcription-Polymerase Chain Reaction (RT-PCR) is performed using cDNA generated from a panel of tissue RNAs. See, e.g., Sambrook et al., *Molecular Cloning: A Laboratory Manual*, 2d ed., Cold Spring Harbor Laboratory Press (1989) and; Kawasaki E S et al., *PNAS* 85(15):5698 (1988). Total RNA is extracted from a variety of tissues and first strand cDNA is prepared with reverse transcriptase (RT). Each panel includes 23 cDNAs from five cancer types (lung, ovary, breast, colon, and prostate) and normal samples of testis, placenta and fetal brain. Each cancer set is composed of three cancer cDNAs from different donors and one normal pooled sample. Using a standard enzyme kit from BD Bioscience Clontech (Mountain View, Calif.), the target transcript is detected with sequence-specific primers designed to only amplify the particular splice variant. The PCR reaction is run on the Gene-Amp PCR system 9700 (Applied Biosystem, Foster City, Calif.) thermocycler under optimal conditions. One of ordinary skill can design appropriate primers and determine optimal conditions. The amplified product is resolved on an agarose gel to detect a band of equivalent size to the predicted RT-PCR product. A band indicated the presence of the splice variant in a sample. The relation of the amplified product to the splice variant was subsequently confirmed by DNA sequencing.

After subcloning, all positively screened clones are sequence verified. The DNA sequence verification results show the splice variant contains the predicted sequence differences in comparison with the reference sequence.

Results for RT-PCR analysis in the table below include the sequence DEX ID, Lead Name, Cancer Tissue(s) the transcript was detected in, Normal Tissue(s) the transcript was detected in, the predicted length of the RT-PCR product, and the confirmed Length of the RT-PCR product.

Example 1d

Secretion Assay

To determine if a protein encoded by a splice variant is secreted from cells a secretion assay is preformed. A pcDNA3.1 clone containing the gene transcript which encodes the variant protein is transfected into 293T cells using the Superfect transfection reagent (Qiagen, Valencia Calif.). Transfected cells are incubated for 28 hours before the media is collected and immediately spun down to remove any detached cells. The adherent cells are solubilized with lysis buffer (1% NP40, 10 mM sodium phosphate pH7.0, and 0.15M NaCl). The lysed cells are collected and spun down and the supernatant extracted as cell lysate. Western immunoblot is carried out in the following manner: 15 µl of the cell lysate and media are run on 4-12% NuPage Bis-Tris gel (Invitrogen, Carlsbad Calif.), and blotted onto a PVDF membrane (Invitrogen, Carlsbad Calif.). The blot is incubated with a polyclonal primary antibody which binds to the variant protein (Imgenex, San Diego Calif.) and polyclonal goat anti-

| DEX ID | Lead Name | Cancer Tissue(s) | Normal Tissue(s) | Predicted Length | Confirmed Length |
|---|---|---|---|---|---|
| DEX0455_019.nt.1 | Ovr224 | Lung, Ovary, Colon, Prostate | Placenta, Fetal brain | 334 bp | 334 bp |
| DEX0455_034.nt.1, DEX0455_034.nt.2 | Ovr223 | Lung, Ovary, Breast, Colon | | 448 bp | 894 bp (exon insertion) |
| DEX0455_034.nt.3 | Ovr223v1 | Lung, Ovary, Breast, Colon, Prostate | Lung, Breast, Colon, Prostate, Placenta | 385 bp | 385 bp |
| DEX0455_034.nt.4 | Ovr223v2 | Lung, Ovary, Breast, Colon, Prostate | Lung, Breast, Colon, Prostate, Placenta | 491 bp | 491 bp |
| DEX0455_037.nt.6 | Ovr229 | Ovary, Prostate | Prostate | 390 bp | 387 bp |
| DEX0455_037.nt.7 | Ovr227 | Prostate | Placenta | 257 bp | 256 bp |
| DEX0455_049.nt.1 | Ovr232 | Lung, Ovary, Breast, Colon | Breast | 134 bp | 134 bp |
| DEX0455_049.nt.2 | Ovr232v1 | Lung, Ovary, Breast, Colon, Prostate | Ovary, Breast | 345 bp | 345 bp |
| DEX0455_049.nt.3 | Ovr232v2 | Lung, Ovary, Breast, Colon, Prostate | Lung, Ovary, Breast, Colon, Prostate | 334 bp | 334 bp |
| DEX0455_049.nt.4 | Ovr232v3 | Colon | Breast | 254 bp | 254 bp |
| DEX0455_053.nt.2 | Ovr110V1 | Ovary, Breast, Prostate | Breast | 383 bp | 383 bp |

RT-PCR results confirm the presence SEQ ID NO: 1-128 in biologic samples and distinguish between related transcripts.

rabbit-peroxidase secondary antibody (Sigma-Aldrich, St. Louis Mo.). The blot is developed with the ECL Plus chemiluminescent detection reagent (Amersham BioSciences, Piscataway N.J.).

Secretion assay results are indicative of SEQ ID NO: 129-295 being a diagnostic marker and/or therapeutic target for cancer.

Example 2a

Gene Expression Analysis

Custom Microarray Experiment—Cancer

Custom oligonucleotide microarrays were provided by Agilent Technologies, Inc. (Palo Alto, Calif.). The microarrays were fabricated by Agilent using their technology for the in-situ synthesis of 60mer oligonucleotides (Hughes, et al. 2001, Nature Biotechnology 19:342-347). The 60mer microarray probes were designed by Agilent, from gene sequences provided by diaDexus, using Agilent proprietary algorithms. Whenever possible two different 60mers were designed for each gene of interest.

All microarray experiments were two-color experiments and were preformed using Agilent-recommended protocols and reagents. Briefly, each microarray was hybridized with cRNAs synthesized from RNA (total RNA for ovarian and prostate, polyA+ RNA for lung, breast and colon samples), isolated from cancer and normal tissues, labeled with fluorescent dyes Cyanine-3 (Cy3) or Cyanine-5 (Cy5) (NEN Life Science Products, Inc., Boston, Mass.) using a linear amplification method (Agilent). In each experiment the experimental sample was RNA isolated from cancer tissue from a single individual and the reference sample was a pool of RNA isolated from normal tissues of the same organ as the cancerous tissue (i.e. normal ovarian tissue in experiments with ovarian cancer samples). Hybridizations were carried out at 60° C., overnight using Agilent in-situ hybridization buffer. Following washing, arrays were scanned with a GenePix 4000B Microarray Scanner (Axon Instruments, Inc., Union City, Calif.). The resulting images were analyzed with GenePix Pro 3.0 Microarray Acquisition and Analysis Software (Axon).

Data normalization and expression profiling were done with Expressionist software from GeneData Inc. (Daly City, Calif./Basel, Switzerland). Gene expression analysis was performed using only experiments that met certain quality criteria. The quality criteria that experiments must meet are a combination of evaluations performed by the Expressionist software and evaluations performed manually using raw and normalized data. To evaluate raw data quality, detection limits (the mean signal for a replicated negative control+2 Standard Deviations (SD)) for each channel were calculated. The detection limit is a measure of non-specific hybridization. Acceptable detection limits were defined for each dye (<80 for Cy5 and <150 for Cy3). Arrays with poor detection limits in one or both channels were not analyzed and the experiments were repeated. To evaluate normalized data quality, positive control elements included in the array were utilized. These array features should have a mean ratio of 1 (no differential expression). If these features have a mean ratio of greater than 1.5-fold up or down, the experiments were not analyzed further and were repeated. In addition to traditional scatter plots demonstrating the distribution of signal in each experiment, the Expressionist software also has minimum thresholding criteria that employ user defined parameters to identify quality data. These thresholds include two distinct quality measurements: 1) minimum area percentage, which is a measure of the integrity of each spot and 2) signal to noise ratio, which ensures that the signal being measured is significantly above any background (nonspecific) signal present. Only those features that met the threshold criteria were included in the filtering and analyses carried out by Expressionist. The thresholding settings employed require a minimum area percentage of 60% [(% pixels>background+2SD)−(% pixels saturated)], and a minimum signal to noise ratio of 2.0 in both channels. By these criteria, very low expressors, saturated features and spots with abnormally high local background were not included in analysis.

Relative expression data was collected from Expressionist based on filtering and clustering analyses. Up-regulated genes were identified using criteria for the percentage of experiments in which the gene is up-regulated by at least 2-fold. In general, up-regulation in ~30% of samples tested was used as a cutoff for filtering.

Two microarray experiments were preformed for each normal and cancer tissue pair. The tissue specific Array Chip for each cancer tissue is a unique microarray specific to that tissue and cancer. The Multi-Cancer Array Chip is a universal microarray that was hybridized with samples from each of the cancers (ovarian, breast, colon, lung, and prostate). See the description below for the experiments specific to the different cancers.

Microarray Experiments and Data Tables

Ovarian Cancer Chips

For ovarian cancer two different chip designs were evaluated with overlapping sets of a total of 19 samples, comparing the expression patterns of ovarian cancer derived total RNA to total RNA isolated from a pool of 9 normal ovarian tissues. For the Multi-Cancer Array Chip, all 19 samples (14 invasive carcinomas, 5 low malignant potential samples were analyzed and for the Ovarian Array Chip, a subset of 17 of these samples (13 invasive carcinomas, 4 low malignant potential samples) were assessed.

The results for the statistically significant up-regulated genes on the Ovarian Array Chip are shown in Table 1. The results for the Multi-Cancer Array Chip are shown in Table 2. The first two columns of each table contain information about the sequence itself (DEX ID, Oligo Name), the next columns show the results obtained for all ("ALL") ovarian cancer samples, invasive carcinomas ("INV") and low malignant potential ("LMP") samples. '% up' indicates the percentage of all experiments in which up-regulation of at least 2-fold was observed (n=19 for the Multi-Cancer Array Chip, n=17 for the Ovarian Array Chip), '% valid up' indicates the percentage of experiments with valid expression values in which up-regulation of at least 2-fold was observed.

TABLE 1

| DEX ID | Oligo Name | Ovr ALL % up n = 17 | Ovr ALL % valid up n = 17 | Ovr INV % up n = 13 | Ovr INV % valid up n = 13 | Ovr LMP % up n = 4 | Ovr LMP % valid up n = 4 |
|---|---|---|---|---|---|---|---|
| DEX0455_001.nt.1 | 34930.01 | 23.5 | 23.5 | 30.8 | 30.8 | 0.0 | 0.0 |
| DEX0455_001.nt.1 | 34930.02 | 23.5 | 23.5 | 30.8 | 30.8 | 0.0 | 0.0 |
| DEX0455_002.nt.1 | 21553.01 | 0.0 | 0.0 | 0.0 | 0.0 | 0.0 | 0.0 |

TABLE 1-continued

| DEX ID | Oligo Name | Ovr ALL % up n = 17 | Ovr ALL % valid up n = 17 | Ovr INV % up n = 13 | Ovr INV % valid up n = 13 | Ovr LMP % up n = 4 | Ovr LMP % valid up n = 4 |
|---|---|---|---|---|---|---|---|
| DEX0455_002.nt.1 | 21553.02 | 0.0 | 0.0 | 0.0 | 0.0 | 0.0 | 0.0 |
| DEX0455_002.nt.1 | 21577.01 | 17.6 | 20.0 | 15.4 | 16.7 | 25.0 | 33.3 |
| DEX0455_002.nt.1 | 21577.02 | 0.0 | 0.0 | 0.0 | 0.0 | 0.0 | 0.0 |
| DEX0455_003.nt.1 | 17466.01 | 11.8 | 11.8 | 7.7 | 7.7 | 25.0 | 25.0 |
| DEX0455_003.nt.1 | 17466.02 | 11.8 | 11.8 | 7.7 | 7.7 | 25.0 | 25.0 |
| DEX0455_005.nt.1 | 20619.01 | 23.5 | 25.0 | 23.1 | 23.1 | 25.0 | 33.3 |
| DEX0455_005.nt.1 | 20619.02 | 17.6 | 20.0 | 15.4 | 16.7 | 25.0 | 33.3 |
| DEX0455_005.nt.1 | 24874.01 | 23.5 | 25.0 | 23.1 | 25.0 | 25.0 | 25.0 |
| DEX0455_005.nt.1 | 24874.02 | 29.4 | 31.2 | 23.1 | 25.0 | 50.0 | 50.0 |
| DEX0455_005.nt.2 | 20619.01 | 23.5 | 25.0 | 23.1 | 23.1 | 25.0 | 33.3 |
| DEX0455_005.nt.2 | 20619.02 | 17.6 | 20.0 | 15.4 | 16.7 | 25.0 | 33.3 |
| DEX0455_005.nt.2 | 24874.01 | 23.5 | 25.0 | 23.1 | 25.0 | 25.0 | 25.0 |
| DEX0455_005.nt.2 | 24874.02 | 29.4 | 31.2 | 23.1 | 25.0 | 50.0 | 50.0 |
| DEX0455_007.nt.1 | 30109.01 | 41.2 | 46.7 | 30.8 | 33.3 | 75.0 | 100.0 |
| DEX0455_007.nt.1 | 30109.02 | 35.3 | 40.0 | 23.1 | 27.3 | 75.0 | 75.0 |
| DEX0455_008.nt.1 | 18508.01 | 23.5 | 44.4 | 30.8 | 44.4 | 0.0 | 0.0 |
| DEX0455_008.nt.1 | 18508.02 | 17.6 | 23.1 | 23.1 | 30.0 | 0.0 | 0.0 |
| DEX0455_008.nt.1 | 22387.01 | 35.3 | 54.5 | 46.2 | 66.7 | 0.0 | 0.0 |
| DEX0455_008.nt.1 | 22387.02 | 41.2 | 43.8 | 53.8 | 58.3 | 0.0 | 0.0 |
| DEX0455_009.nt.1 | 9720.01 | 47.1 | 47.1 | 38.5 | 38.5 | 75.0 | 75.0 |
| DEX0455_009.nt.1 | 9720.02 | 52.9 | 52.9 | 46.2 | 46.2 | 75.0 | 75.0 |
| DEX0455_010.nt.1 | 20627.01 | 17.6 | 17.6 | 23.1 | 23.1 | 0.0 | 0.0 |
| DEX0455_010.nt.1 | 20627.02 | 23.5 | 25.0 | 23.1 | 25.0 | 25.0 | 25.0 |
| DEX0455_010.nt.1 | 21675.01 | 11.8 | 11.8 | 15.4 | 15.4 | 0.0 | 0.0 |
| DEX0455_010.nt.1 | 21675.02 | 11.8 | 11.8 | 15.4 | 15.4 | 0.0 | 0.0 |
| DEX0455_010.nt.2 | 21675.01 | 11.8 | 11.8 | 15.4 | 15.4 | 0.0 | 0.0 |
| DEX0455_010.nt.2 | 21675.02 | 11.8 | 11.8 | 15.4 | 15.4 | 0.0 | 0.0 |
| DEX0455_013.nt.1 | 9838.01 | 35.3 | 42.9 | 38.5 | 45.5 | 25.0 | 33.3 |
| DEX0455_013.nt.1 | 9838.02 | 35.3 | 37.5 | 38.5 | 38.5 | 25.0 | 33.3 |
| DEX0455_013.nt.2 | 9838.01 | 35.3 | 42.9 | 38.5 | 45.5 | 25.0 | 33.3 |
| DEX0455_013.nt.2 | 9838.02 | 35.3 | 37.5 | 38.5 | 38.5 | 25.0 | 33.3 |
| DEX0455_014.nt.1 | 10624.01 | 17.6 | 50.0 | 15.4 | 50.0 | 25.0 | 50.0 |
| DEX0455_014.nt.1 | 10624.02 | 17.6 | 50.0 | 7.7 | 33.3 | 50.0 | 66.7 |
| DEX0455_014.nt.1 | 14604.01 | 0.0 | 0.0 | 0.0 | 0.0 | 0.0 | 0.0 |
| DEX0455_014.nt.1 | 14604.02 | 0.0 | 0.0 | 0.0 | 0.0 | 0.0 | 0.0 |
| DEX0455_015.nt.1 | 19518.01 | 29.4 | 29.4 | 38.5 | 38.5 | 0.0 | 0.0 |
| DEX0455_015.nt.1 | 19518.02 | 29.4 | 29.4 | 38.5 | 38.5 | 0.0 | 0.0 |
| DEX0455_016.nt.1 | 23734.01 | 5.9 | 6.2 | 7.7 | 7.7 | 0.0 | 0.0 |
| DEX0455_016.nt.1 | 23734.02 | 11.8 | 11.8 | 15.4 | 15.4 | 0.0 | 0.0 |
| DEX0455_018.nt.1 | 21571.01 | 0.0 | 0.0 | 0.0 | 0.0 | 0.0 | 0.0 |
| DEX0455_018.nt.1 | 21571.02 | 0.0 | 0.0 | 0.0 | 0.0 | 0.0 | 0.0 |
| DEX0455_018.nt.1 | 21575.01 | 41.2 | 41.2 | 46.2 | 46.2 | 25.0 | 25.0 |
| DEX0455_018.nt.1 | 21575.02 | 41.2 | 41.2 | 46.2 | 46.2 | 25.0 | 25.0 |
| DEX0455_018.nt.1 | 21609.01 | 0.0 | 0.0 | 0.0 | 0.0 | 0.0 | 0.0 |
| DEX0455_018.nt.1 | 21609.02 | 0.0 | 0.0 | 0.0 | 0.0 | 0.0 | 0.0 |
| DEX0455_018.nt.2 | 21575.01 | 41.2 | 41.2 | 46.2 | 46.2 | 25.0 | 25.0 |
| DEX0455_018.nt.2 | 21575.02 | 41.2 | 41.2 | 46.2 | 46.2 | 25.0 | 25.0 |
| DEX0455_019.nt.1 | 20669.01 | 35.3 | 42.9 | 46.2 | 50.0 | 0.0 | 0.0 |
| DEX0455_019.nt.1 | 20669.02 | 35.3 | 46.2 | 46.2 | 50.0 | 0.0 | 0.0 |
| DEX0455_021.nt.1 | 21433.01 | 64.7 | 64.7 | 61.5 | 61.5 | 75.0 | 75.0 |
| DEX0455_021.nt.1 | 21433.02 | 64.7 | 64.7 | 61.5 | 61.5 | 75.0 | 75.0 |
| DEX0455_021.nt.1 | 21469.01 | 70.6 | 70.6 | 61.5 | 61.5 | 100.0 | 100.0 |
| DEX0455_021.nt.1 | 21469.02 | 82.4 | 82.4 | 76.9 | 76.9 | 100.0 | 100.0 |
| DEX0455_021.nt.1 | 21475.01 | 58.8 | 58.8 | 53.8 | 53.8 | 75.0 | 75.0 |
| DEX0455_021.nt.1 | 21475.02 | 52.9 | 52.9 | 53.8 | 53.8 | 50.0 | 50.0 |
| DEX0455_021.nt.1 | 23780.01 | 47.1 | 47.1 | 46.2 | 46.2 | 50.0 | 50.0 |
| DEX0455_021.nt.1 | 23780.02 | 41.2 | 50.0 | 46.2 | 54.5 | 25.0 | 33.3 |
| DEX0455_021.nt.2 | 21433.01 | 64.7 | 64.7 | 61.5 | 61.5 | 75.0 | 75.0 |
| DEX0455_021.nt.2 | 21433.02 | 64.7 | 64.7 | 61.5 | 61.5 | 75.0 | 75.0 |
| DEX0455_021.nt.2 | 21469.01 | 70.6 | 70.6 | 61.5 | 61.5 | 100.0 | 100.0 |
| DEX0455_021.nt.2 | 21469.02 | 82.4 | 82.4 | 76.9 | 76.9 | 100.0 | 100.0 |
| DEX0455_021.nt.2 | 21475.01 | 58.8 | 58.8 | 53.8 | 53.8 | 75.0 | 75.0 |
| DEX0455_021.nt.2 | 21475.02 | 52.9 | 52.9 | 53.8 | 53.8 | 50.0 | 50.0 |
| DEX0455_021.nt.2 | 23780.01 | 47.1 | 47.1 | 46.2 | 46.2 | 50.0 | 50.0 |
| DEX0455_021.nt.2 | 23780.02 | 41.2 | 50.0 | 46.2 | 54.5 | 25.0 | 33.3 |
| DEX0455_021.nt.3 | 21433.01 | 64.7 | 64.7 | 61.5 | 61.5 | 75.0 | 75.0 |
| DEX0455_021.nt.3 | 21433.02 | 64.7 | 64.7 | 61.5 | 61.5 | 75.0 | 75.0 |
| DEX0455_021.nt.3 | 21469.01 | 70.6 | 70.6 | 61.5 | 61.5 | 100.0 | 100.0 |
| DEX0455_021.nt.3 | 21469.02 | 82.4 | 82.4 | 76.9 | 76.9 | 100.0 | 100.0 |
| DEX0455_021.nt.3 | 21475.01 | 58.8 | 58.8 | 53.8 | 53.8 | 75.0 | 75.0 |
| DEX0455_021.nt.3 | 21475.02 | 52.9 | 52.9 | 53.8 | 53.8 | 50.0 | 50.0 |
| DEX0455_021.nt.3 | 23780.01 | 47.1 | 47.1 | 46.2 | 46.2 | 50.0 | 50.0 |
| DEX0455_021.nt.3 | 23780.02 | 41.2 | 50.0 | 46.2 | 54.5 | 25.0 | 33.3 |
| DEX0455_021.nt.4 | 21433.01 | 64.7 | 64.7 | 61.5 | 61.5 | 75.0 | 75.0 |
| DEX0455_021.nt.4 | 21433.02 | 64.7 | 64.7 | 61.5 | 61.5 | 75.0 | 75.0 |

TABLE 1-continued

| DEX ID | Oligo Name | Ovr ALL % up n = 17 | Ovr ALL % valid up n = 17 | Ovr INV % up n = 13 | Ovr INV % valid n = 13 | Ovr LMP % up n = 4 | Ovr LMP % valid up n = 4 |
|---|---|---|---|---|---|---|---|
| DEX0455_021.nt.4 | 21469.01 | 70.6 | 70.6 | 61.5 | 61.5 | 100.0 | 100.0 |
| DEX0455_021.nt.4 | 21469.02 | 82.4 | 82.4 | 76.9 | 76.9 | 100.0 | 100.0 |
| DEX0455_021.nt.4 | 21475.01 | 58.8 | 58.8 | 53.8 | 53.8 | 75.0 | 75.0 |
| DEX0455_021.nt.4 | 21475.02 | 52.9 | 52.9 | 53.8 | 53.8 | 50.0 | 50.0 |
| DEX0455_021.nt.4 | 23780.01 | 47.1 | 47.1 | 46.2 | 46.2 | 50.0 | 50.0 |
| DEX0455_021.nt.4 | 23780.02 | 41.2 | 50.0 | 46.2 | 54.5 | 25.0 | 33.3 |
| DEX0455_022.nt.1 | 9920.01 | 23.5 | 23.5 | 30.8 | 30.8 | 0.0 | 0.0 |
| DEX0455_022.nt.1 | 9920.02 | 23.5 | 23.5 | 30.8 | 30.8 | 0.0 | 0.0 |
| DEX0455_022.nt.1 | 20299.01 | 17.6 | 18.8 | 23.1 | 25.0 | 0.0 | 0.0 |
| DEX0455_022.nt.1 | 20299.02 | 17.6 | 17.6 | 23.1 | 23.1 | 0.0 | 0.0 |
| DEX0455_022.nt.1 | 20311.01 | 17.6 | 17.6 | 23.1 | 23.1 | 0.0 | 0.0 |
| DEX0455_022.nt.1 | 20311.02 | 17.6 | 17.6 | 23.1 | 23.1 | 0.0 | 0.0 |
| DEX0455_022.nt.1 | 20317.01 | 17.6 | 17.6 | 23.1 | 23.1 | 0.0 | 0.0 |
| DEX0455_022.nt.1 | 20317.02 | 17.6 | 17.6 | 23.1 | 23.1 | 0.0 | 0.0 |
| DEX0455_022.nt.2 | 9920.01 | 23.5 | 23.5 | 30.8 | 30.8 | 0.0 | 0.0 |
| DEX0455_022.nt.2 | 9920.02 | 23.5 | 23.5 | 30.8 | 30.8 | 0.0 | 0.0 |
| DEX0455_022.nt.2 | 20299.01 | 17.6 | 18.8 | 23.1 | 25.0 | 0.0 | 0.0 |
| DEX0455_022.nt.2 | 20299.02 | 17.6 | 17.6 | 23.1 | 23.1 | 0.0 | 0.0 |
| DEX0455_022.nt.2 | 20311.01 | 17.6 | 17.6 | 23.1 | 23.1 | 0.0 | 0.0 |
| DEX0455_022.nt.2 | 20311.02 | 17.6 | 17.6 | 23.1 | 23.1 | 0.0 | 0.0 |
| DEX0455_022.nt.2 | 20317.01 | 17.6 | 17.6 | 23.1 | 23.1 | 0.0 | 0.0 |
| DEX0455_022.nt.2 | 20317.02 | 17.6 | 17.6 | 23.1 | 23.1 | 0.0 | 0.0 |
| DEX0455_022.nt.3 | 9920.01 | 23.5 | 23.5 | 30.8 | 30.8 | 0.0 | 0.0 |
| DEX0455_022.nt.3 | 9920.02 | 23.5 | 23.5 | 30.8 | 30.8 | 0.0 | 0.0 |
| DEX0455_022.nt.3 | 20311.01 | 17.6 | 17.6 | 23.1 | 23.1 | 0.0 | 0.0 |
| DEX0455_022.nt.3 | 20311.02 | 17.6 | 17.6 | 23.1 | 23.1 | 0.0 | 0.0 |
| DEX0455_022.nt.3 | 20317.01 | 17.6 | 17.6 | 23.1 | 23.1 | 0.0 | 0.0 |
| DEX0455_022.nt.3 | 20317.02 | 17.6 | 17.6 | 23.1 | 23.1 | 0.0 | 0.0 |
| DEX0455_023.nt.1 | 16187.01 | 0.0 | 0.0 | 0.0 | 0.0 | 0.0 | 0.0 |
| DEX0455_023.nt.1 | 16187.02 | 0.0 | 0.0 | 0.0 | 0.0 | 0.0 | 0.0 |
| DEX0455_023.nt.1 | 16374.01 | 23.5 | 23.5 | 30.8 | 30.8 | 0.0 | 0.0 |
| DEX0455_023.nt.1 | 16374.02 | 17.6 | 17.6 | 23.1 | 23.1 | 0.0 | 0.0 |
| DEX0455_023.nt.1 | 16378.01 | 0.0 | 0.0 | 0.0 | 0.0 | 0.0 | 0.0 |
| DEX0455_023.nt.1 | 16378.02 | 0.0 | 0.0 | 0.0 | 0.0 | 0.0 | 0.0 |
| DEX0455_024.nt.1 | 12149.01 | 52.9 | 52.9 | 46.2 | 46.2 | 75.0 | 75.0 |
| DEX0455_024.nt.1 | 12149.02 | 47.1 | 47.1 | 38.5 | 38.5 | 75.0 | 75.0 |
| DEX0455_024.nt.1 | 21487.01 | 5.9 | 6.7 | 7.7 | 8.3 | 0.0 | 0.0 |
| DEX0455_024.nt.1 | 21487.02 | 17.6 | 18.8 | 15.4 | 16.7 | 25.0 | 25.0 |
| DEX0455_024.nt.1 | 21507.01 | 29.4 | 29.4 | 23.1 | 23.1 | 50.0 | 50.0 |
| DEX0455_024.nt.1 | 21507.02 | 29.4 | 31.2 | 23.1 | 25.0 | 50.0 | 50.0 |
| DEX0455_024.nt.1 | 21547.01 | 47.1 | 47.1 | 46.2 | 46.2 | 50.0 | 50.0 |
| DEX0455_024.nt.1 | 21547.02 | 41.2 | 41.2 | 38.5 | 38.5 | 50.0 | 50.0 |
| DEX0455_024.nt.2 | 12149.01 | 52.9 | 52.9 | 46.2 | 46.2 | 75.0 | 75.0 |
| DEX0455_024.nt.2 | 12149.02 | 47.1 | 47.1 | 38.5 | 38.5 | 75.0 | 75.0 |
| DEX0455_024.nt.2 | 21507.01 | 29.4 | 29.4 | 23.1 | 23.1 | 50.0 | 50.0 |
| DEX0455_024.nt.2 | 21507.02 | 29.4 | 31.2 | 23.1 | 25.0 | 50.0 | 50.0 |
| DEX0455_024.nt.2 | 21547.01 | 47.1 | 47.1 | 46.2 | 46.2 | 50.0 | 50.0 |
| DEX0455_024.nt.2 | 21547.02 | 41.2 | 41.2 | 38.5 | 38.5 | 50.0 | 50.0 |
| DEX0455_025.nt.1 | 12167.01 | 17.6 | 18.8 | 23.1 | 23.1 | 0.0 | 0.0 |
| DEX0455_025.nt.1 | 12167.02 | 11.8 | 11.8 | 15.4 | 15.4 | 0.0 | 0.0 |
| DEX0455_025.nt.1 | 16956.01 | 5.9 | 5.9 | 7.7 | 7.7 | 0.0 | 0.0 |
| DEX0455_025.nt.1 | 16956.02 | 5.9 | 5.9 | 7.7 | 7.7 | 0.0 | 0.0 |
| DEX0455_025.nt.1 | 16958.01 | 0.0 | 0.0 | 0.0 | 0.0 | 0.0 | 0.0 |
| DEX0455_025.nt.1 | 16958.02 | 0.0 | 0.0 | 0.0 | 0.0 | 0.0 | 0.0 |
| DEX0455_025.nt.1 | 16964.01 | 5.9 | 5.9 | 7.7 | 7.7 | 0.0 | 0.0 |
| DEX0455_025.nt.1 | 16964.02 | 5.9 | 5.9 | 7.7 | 7.7 | 0.0 | 0.0 |
| DEX0455_025.nt.1 | 19010.01 | 0.0 | 0.0 | 0.0 | 0.0 | 0.0 | 0.0 |
| DEX0455_025.nt.1 | 19010.02 | 0.0 | 0.0 | 0.0 | 0.0 | 0.0 | 0.0 |
| DEX0455_025.nt.2 | 12167.01 | 17.6 | 18.8 | 23.1 | 23.1 | 0.0 | 0.0 |
| DEX0455_025.nt.2 | 12167.02 | 11.8 | 11.8 | 15.4 | 15.4 | 0.0 | 0.0 |
| DEX0455_025.nt.2 | 16956.01 | 5.9 | 5.9 | 7.7 | 7.7 | 0.0 | 0.0 |
| DEX0455_025.nt.2 | 16956.02 | 5.9 | 5.9 | 7.7 | 7.7 | 0.0 | 0.0 |
| DEX0455_025.nt.2 | 16958.01 | 0.0 | 0.0 | 0.0 | 0.0 | 0.0 | 0.0 |
| DEX0455_025.nt.2 | 16958.02 | 0.0 | 0.0 | 0.0 | 0.0 | 0.0 | 0.0 |
| DEX0455_025.nt.2 | 16964.01 | 5.9 | 5.9 | 7.7 | 7.7 | 0.0 | 0.0 |
| DEX0455_025.nt.2 | 16964.02 | 5.9 | 5.9 | 7.7 | 7.7 | 0.0 | 0.0 |
| DEX0455_025.nt.2 | 19010.01 | 0.0 | 0.0 | 0.0 | 0.0 | 0.0 | 0.0 |
| DEX0455_025.nt.2 | 19010.02 | 0.0 | 0.0 | 0.0 | 0.0 | 0.0 | 0.0 |
| DEX0455_025.nt.3 | 12167.01 | 17.6 | 18.8 | 23.1 | 23.1 | 0.0 | 0.0 |
| DEX0455_025.nt.3 | 12167.02 | 11.8 | 11.8 | 15.4 | 15.4 | 0.0 | 0.0 |
| DEX0455_025.nt.3 | 16958.01 | 0.0 | 0.0 | 0.0 | 0.0 | 0.0 | 0.0 |
| DEX0455_025.nt.3 | 16958.02 | 0.0 | 0.0 | 0.0 | 0.0 | 0.0 | 0.0 |
| DEX0455_025.nt.3 | 19010.01 | 0.0 | 0.0 | 0.0 | 0.0 | 0.0 | 0.0 |
| DEX0455_025.nt.3 | 19010.02 | 0.0 | 0.0 | 0.0 | 0.0 | 0.0 | 0.0 |
| DEX0455_025.nt.4 | 12167.01 | 17.6 | 18.8 | 23.1 | 23.1 | 0.0 | 0.0 |

TABLE 1-continued

| DEX ID | Oligo Name | Ovr ALL % up n = 17 | Ovr ALL % valid up n = 17 | Ovr INV % up n = 13 | Ovr INV % valid up n = 13 | Ovr LMP % up n = 4 | Ovr LMP % valid up n = 4 |
|---|---|---|---|---|---|---|---|
| DEX0455_025.nt.4 | 12167.02 | 11.8 | 11.8 | 15.4 | 15.4 | 0.0 | 0.0 |
| DEX0455_025.nt.4 | 16956.01 | 5.9 | 5.9 | 7.7 | 7.7 | 0.0 | 0.0 |
| DEX0455_025.nt.4 | 16956.02 | 5.9 | 5.9 | 7.7 | 7.7 | 0.0 | 0.0 |
| DEX0455_025.nt.4 | 16958.01 | 0.0 | 0.0 | 0.0 | 0.0 | 0.0 | 0.0 |
| DEX0455_025.nt.4 | 16958.02 | 0.0 | 0.0 | 0.0 | 0.0 | 0.0 | 0.0 |
| DEX0455_025.nt.4 | 16964.01 | 5.9 | 5.9 | 7.7 | 7.7 | 0.0 | 0.0 |
| DEX0455_025.nt.4 | 16964.02 | 5.9 | 5.9 | 7.7 | 7.7 | 0.0 | 0.0 |
| DEX0455_025.nt.4 | 19010.01 | 0.0 | 0.0 | 0.0 | 0.0 | 0.0 | 0.0 |
| DEX0455_025.nt.4 | 19010.02 | 0.0 | 0.0 | 0.0 | 0.0 | 0.0 | 0.0 |
| DEX0455_027.nt.1 | 21549.01 | 29.4 | 31.2 | 23.1 | 25.0 | 50.0 | 50.0 |
| DEX0455_027.nt.1 | 21549.02 | 29.4 | 31.2 | 23.1 | 25.0 | 50.0 | 50.0 |
| DEX0455_029.nt.1 | 17430.01 | 23.5 | 23.5 | 30.8 | 30.8 | 0.0 | 0.0 |
| DEX0455_029.nt.1 | 17430.02 | 17.6 | 17.6 | 23.1 | 23.1 | 0.0 | 0.0 |
| DEX0455_029.nt.1 | 17448.01 | 11.8 | 11.8 | 15.4 | 15.4 | 0.0 | 0.0 |
| DEX0455_029.nt.1 | 17448.02 | 17.6 | 17.6 | 23.1 | 23.1 | 0.0 | 0.0 |
| DEX0455_029.nt.1 | 22113.01 | 11.8 | 25.0 | 15.4 | 28.6 | 0.0 | 0.0 |
| DEX0455_029.nt.1 | 22113.02 | 11.8 | 20.0 | 15.4 | 25.0 | 0.0 | 0.0 |
| DEX0455_029.nt.1 | 23386.01 | 17.6 | 17.6 | 23.1 | 23.1 | 0.0 | 0.0 |
| DEX0455_029.nt.1 | 23386.02 | 17.6 | 17.6 | 23.1 | 23.1 | 0.0 | 0.0 |
| DEX0455_029.nt.1 | 23400.01 | 0.0 | 0.0 | 0.0 | 0.0 | 0.0 | 0.0 |
| DEX0455_029.nt.1 | 23400.02 | 0.0 | 0.0 | 0.0 | 0.0 | 0.0 | 0.0 |
| DEX0455_029.nt.2 | 17424.01 | 17.6 | 17.6 | 23.1 | 23.1 | 0.0 | 0.0 |
| DEX0455_029.nt.2 | 17424.02 | 17.6 | 17.6 | 23.1 | 23.1 | 0.0 | 0.0 |
| DEX0455_029.nt.2 | 17430.01 | 23.5 | 23.5 | 30.8 | 30.8 | 0.0 | 0.0 |
| DEX0455_029.nt.2 | 17430.02 | 17.6 | 17.6 | 23.1 | 23.1 | 0.0 | 0.0 |
| DEX0455_029.nt.2 | 17448.01 | 11.8 | 11.8 | 15.4 | 15.4 | 0.0 | 0.0 |
| DEX0455_029.nt.2 | 17448.02 | 17.6 | 17.6 | 23.1 | 23.1 | 0.0 | 0.0 |
| DEX0455_029.nt.2 | 22113.01 | 11.8 | 25.0 | 15.4 | 28.6 | 0.0 | 0.0 |
| DEX0455_029.nt.2 | 22113.02 | 11.8 | 20.0 | 15.4 | 25.0 | 0.0 | 0.0 |
| DEX0455_029.nt.2 | 23386.01 | 17.6 | 17.6 | 23.1 | 23.1 | 0.0 | 0.0 |
| DEX0455_029.nt.2 | 23386.02 | 17.6 | 17.6 | 23.1 | 23.1 | 0.0 | 0.0 |
| DEX0455_029.nt.2 | 23400.01 | 0.0 | 0.0 | 0.0 | 0.0 | 0.0 | 0.0 |
| DEX0455_029.nt.2 | 23400.02 | 0.0 | 0.0 | 0.0 | 0.0 | 0.0 | 0.0 |
| DEX0455_030.nt.1 | 11613.01 | 11.8 | 11.8 | 15.4 | 15.4 | 0.0 | 0.0 |
| DEX0455_030.nt.1 | 11613.02 | 11.8 | 13.3 | 15.4 | 16.7 | 0.0 | 0.0 |
| DEX0455_030.nt.1 | 17204.01 | 0.0 | 0.0 | 0.0 | 0.0 | 0.0 | 0.0 |
| DEX0455_030.nt.1 | 17204.02 | 0.0 | 0.0 | 0.0 | 0.0 | 0.0 | 0.0 |
| DEX0455_030.nt.1 | 17262.01 | 17.6 | 17.6 | 23.1 | 23.1 | 0.0 | 0.0 |
| DEX0455_030.nt.1 | 17262.02 | 17.6 | 17.6 | 23.1 | 23.1 | 0.0 | 0.0 |
| DEX0455_030.nt.1 | 17278.01 | 23.5 | 23.5 | 30.8 | 30.8 | 0.0 | 0.0 |
| DEX0455_030.nt.1 | 17278.02 | 17.6 | 17.6 | 23.1 | 23.1 | 0.0 | 0.0 |
| DEX0455_030.nt.2 | 11613.01 | 11.8 | 11.8 | 15.4 | 15.4 | 0.0 | 0.0 |
| DEX0455_030.nt.2 | 11613.02 | 11.8 | 13.3 | 15.4 | 16.7 | 0.0 | 0.0 |
| DEX0455_030.nt.2 | 17204.01 | 0.0 | 0.0 | 0.0 | 0.0 | 0.0 | 0.0 |
| DEX0455_030.nt.2 | 17204.02 | 0.0 | 0.0 | 0.0 | 0.0 | 0.0 | 0.0 |
| DEX0455_030.nt.2 | 17262.01 | 17.6 | 17.6 | 23.1 | 23.1 | 0.0 | 0.0 |
| DEX0455_030.nt.2 | 17262.02 | 17.6 | 17.6 | 23.1 | 23.1 | 0.0 | 0.0 |
| DEX0455_030.nt.2 | 17274.01 | 17.6 | 17.6 | 23.1 | 23.1 | 0.0 | 0.0 |
| DEX0455_030.nt.2 | 17274.02 | 17.6 | 17.6 | 23.1 | 23.1 | 0.0 | 0.0 |
| DEX0455_030.nt.2 | 17278.01 | 23.5 | 23.5 | 30.8 | 30.8 | 0.0 | 0.0 |
| DEX0455_030.nt.2 | 17278.02 | 17.6 | 17.6 | 23.1 | 23.1 | 0.0 | 0.0 |
| DEX0455_031.nt.1 | 20773.01 | 17.6 | 17.6 | 23.1 | 23.1 | 0.0 | 0.0 |
| DEX0455_031.nt.1 | 20773.02 | 23.5 | 25.0 | 30.8 | 33.3 | 0.0 | 0.0 |
| DEX0455_031.nt.2 | 20773.01 | 17.6 | 17.6 | 23.1 | 23.1 | 0.0 | 0.0 |
| DEX0455_031.nt.2 | 20773.02 | 23.5 | 25.0 | 30.8 | 33.3 | 0.0 | 0.0 |
| DEX0455_031.nt.3 | 20773.01 | 17.6 | 17.6 | 23.1 | 23.1 | 0.0 | 0.0 |
| DEX0455_031.nt.3 | 20773.02 | 23.5 | 25.0 | 30.8 | 33.3 | 0.0 | 0.0 |
| DEX0455_032.nt.1 | 11585.01 | 0.0 | 0.0 | 0.0 | 0.0 | 0.0 | 0.0 |
| DEX0455_032.nt.1 | 11585.02 | 0.0 | 0.0 | 0.0 | 0.0 | 0.0 | 0.0 |
| DEX0455_032.nt.1 | 18556.01 | 0.0 | 0.0 | 0.0 | 0.0 | 0.0 | 0.0 |
| DEX0455_032.nt.1 | 18556.02 | 0.0 | 0.0 | 0.0 | 0.0 | 0.0 | 0.0 |
| DEX0455_034.nt.1 | 10722.01 | 82.4 | 82.4 | 84.6 | 84.6 | 75.0 | 75.0 |
| DEX0455_034.nt.1 | 10722.02 | 76.5 | 81.2 | 84.6 | 84.6 | 50.0 | 66.7 |
| DEX0455_034.nt.1 | 21401.01 | 0.0 | 0.0 | 0.0 | 0.0 | 0.0 | 0.0 |
| DEX0455_034.nt.1 | 21401.02 | 5.9 | 6.7 | 7.7 | 8.3 | 0.0 | 0.0 |
| DEX0455_034.nt.1 | 21421.01 | 0.0 | 0.0 | 0.0 | 0.0 | 0.0 | 0.0 |
| DEX0455_034.nt.1 | 21421.02 | 0.0 | 0.0 | 0.0 | 0.0 | 0.0 | 0.0 |
| DEX0455_035.nt.1 | 103385.01 | 58.8 | 58.8 | 76.9 | 76.9 | 0.0 | 0.0 |
| DEX0455_035.nt.1 | 103385.02 | 58.8 | 58.8 | 76.9 | 76.9 | 0.0 | 0.0 |
| DEX0455_035.nt.2 | 103385.01 | 58.8 | 58.8 | 76.9 | 76.9 | 0.0 | 0.0 |
| DEX0455_035.nt.2 | 103385.02 | 58.8 | 58.8 | 76.9 | 76.9 | 0.0 | 0.0 |
| DEX0455_035.nt.3 | 103385.01 | 58.8 | 58.8 | 76.9 | 76.9 | 0.0 | 0.0 |
| DEX0455_035.nt.3 | 103385.02 | 58.8 | 58.8 | 76.9 | 76.9 | 0.0 | 0.0 |
| DEX0455_036.nt.1 | 92327.01 | 52.9 | 56.2 | 61.5 | 66.7 | 25.0 | 25.0 |
| DEX0455_036.nt.1 | 92327.02 | 52.9 | 52.9 | 61.5 | 61.5 | 25.0 | 25.0 |

TABLE 1-continued

| DEX ID | Oligo Name | Ovr ALL % up n = 17 | Ovr ALL % valid up n = 17 | Ovr INV % up n = 13 | Ovr INV % valid up n = 13 | Ovr LMP % up n = 4 | Ovr LMP % valid up n = 4 |
| --- | --- | --- | --- | --- | --- | --- | --- |
| DEX0455_036.nt.2 | 92327.01 | 52.9 | 56.2 | 61.5 | 66.7 | 25.0 | 25.0 |
| DEX0455_036.nt.2 | 92327.02 | 52.9 | 52.9 | 61.5 | 61.5 | 25.0 | 25.0 |
| DEX0455_036.nt.3 | 92327.01 | 52.9 | 56.2 | 61.5 | 66.7 | 25.0 | 25.0 |
| DEX0455_036.nt.3 | 92327.02 | 52.9 | 52.9 | 61.5 | 61.5 | 25.0 | 25.0 |
| DEX0455_036.nt.4 | 92327.01 | 52.9 | 56.2 | 61.5 | 66.7 | 25.0 | 25.0 |
| DEX0455_036.nt.4 | 92327.02 | 52.9 | 52.9 | 61.5 | 61.5 | 25.0 | 25.0 |
| DEX0455_037.nt.1 | 11575.01 | 52.9 | 52.9 | 53.8 | 53.8 | 50.0 | 50.0 |
| DEX0455_037.nt.1 | 11575.02 | 52.9 | 52.9 | 53.8 | 53.8 | 50.0 | 50.0 |
| DEX0455_037.nt.1 | 17486.01 | 47.1 | 47.1 | 46.2 | 46.2 | 50.0 | 50.0 |
| DEX0455_037.nt.1 | 17486.02 | 47.1 | 47.1 | 46.2 | 46.2 | 50.0 | 50.0 |
| DEX0455_037.nt.1 | 17490.01 | 52.9 | 52.9 | 53.8 | 53.8 | 50.0 | 50.0 |
| DEX0455_037.nt.1 | 17490.02 | 58.8 | 58.8 | 53.8 | 53.8 | 75.0 | 75.0 |
| DEX0455_037.nt.2 | 11575.01 | 52.9 | 52.9 | 53.8 | 53.8 | 50.0 | 50.0 |
| DEX0455_037.nt.2 | 11575.02 | 52.9 | 52.9 | 53.8 | 53.8 | 50.0 | 50.0 |
| DEX0455_037.nt.2 | 17486.01 | 47.1 | 47.1 | 46.2 | 46.2 | 50.0 | 50.0 |
| DEX0455_037.nt.2 | 17486.02 | 47.1 | 47.1 | 46.2 | 46.2 | 50.0 | 50.0 |
| DEX0455_037.nt.2 | 17490.01 | 52.9 | 52.9 | 53.8 | 53.8 | 50.0 | 50.0 |
| DEX0455_037.nt.2 | 17490.02 | 58.8 | 58.8 | 53.8 | 53.8 | 75.0 | 75.0 |
| DEX0455_037.nt.3 | 11575.01 | 52.9 | 52.9 | 53.8 | 53.8 | 50.0 | 50.0 |
| DEX0455_037.nt.3 | 11575.02 | 52.9 | 52.9 | 53.8 | 53.8 | 50.0 | 50.0 |
| DEX0455_037.nt.3 | 17486.01 | 47.1 | 47.1 | 46.2 | 46.2 | 50.0 | 50.0 |
| DEX0455_037.nt.3 | 17486.02 | 47.1 | 47.1 | 46.2 | 46.2 | 50.0 | 50.0 |
| DEX0455_037.nt.3 | 17490.01 | 52.9 | 52.9 | 53.8 | 53.8 | 50.0 | 50.0 |
| DEX0455_037.nt.3 | 17490.02 | 58.8 | 58.8 | 53.8 | 53.8 | 75.0 | 75.0 |
| DEX0455_037.nt.4 | 11575.01 | 52.9 | 52.9 | 53.8 | 53.8 | 50.0 | 50.0 |
| DEX0455_037.nt.4 | 11575.02 | 52.9 | 52.9 | 53.8 | 53.8 | 50.0 | 50.0 |
| DEX0455_037.nt.4 | 17486.01 | 47.1 | 47.1 | 46.2 | 46.2 | 50.0 | 50.0 |
| DEX0455_037.nt.4 | 17486.02 | 47.1 | 47.1 | 46.2 | 46.2 | 50.0 | 50.0 |
| DEX0455_037.nt.4 | 17490.01 | 52.9 | 52.9 | 53.8 | 53.8 | 50.0 | 50.0 |
| DEX0455_037.nt.4 | 17490.02 | 58.8 | 58.8 | 53.8 | 53.8 | 75.0 | 75.0 |
| DEX0455_037.nt.5 | 11575.01 | 52.9 | 52.9 | 53.8 | 53.8 | 50.0 | 50.0 |
| DEX0455_037.nt.5 | 11575.02 | 52.9 | 52.9 | 53.8 | 53.8 | 50.0 | 50.0 |
| DEX0455_037.nt.5 | 17486.01 | 47.1 | 47.1 | 46.2 | 46.2 | 50.0 | 50.0 |
| DEX0455_037.nt.5 | 17486.02 | 47.1 | 47.1 | 46.2 | 46.2 | 50.0 | 50.0 |
| DEX0455_037.nt.5 | 17490.01 | 52.9 | 52.9 | 53.8 | 53.8 | 50.0 | 50.0 |
| DEX0455_037.nt.5 | 17490.02 | 58.8 | 58.8 | 53.8 | 53.8 | 75.0 | 75.0 |
| DEX0455_039.nt.1 | 21505.01 | 94.1 | 94.1 | 92.3 | 92.3 | 100.0 | 100.0 |
| DEX0455_039.nt.1 | 21505.02 | 94.1 | 94.1 | 92.3 | 92.3 | 100.0 | 100.0 |
| DEX0455_039.nt.2 | 11527.01 | 88.2 | 88.2 | 84.6 | 84.6 | 100.0 | 100.0 |
| DEX0455_039.nt.2 | 11527.02 | 88.2 | 88.2 | 84.6 | 84.6 | 100.0 | 100.0 |
| DEX0455_040.nt.1 | 21489.01 | 11.8 | 11.8 | 15.4 | 15.4 | 0.0 | 0.0 |
| DEX0455_040.nt.1 | 21489.02 | 17.6 | 18.8 | 23.1 | 23.1 | 0.0 | 0.0 |
| DEX0455_040.nt.1 | 21501.01 | 47.1 | 50.0 | 61.5 | 61.5 | 0.0 | 0.0 |
| DEX0455_040.nt.1 | 21501.02 | 41.2 | 41.2 | 53.8 | 53.8 | 0.0 | 0.0 |
| DEX0455_040.nt.1 | 21511.01 | 47.1 | 47.1 | 61.5 | 61.5 | 0.0 | 0.0 |
| DEX0455_040.nt.1 | 21511.02 | 47.1 | 47.1 | 53.8 | 53.8 | 25.0 | 25.0 |
| DEX0455_040.nt.2 | 21489.01 | 11.8 | 11.8 | 15.4 | 15.4 | 0.0 | 0.0 |
| DEX0455_040.nt.2 | 21489.02 | 17.6 | 18.8 | 23.1 | 23.1 | 0.0 | 0.0 |
| DEX0455_040.nt.2 | 21501.01 | 47.1 | 50.0 | 61.5 | 61.5 | 0.0 | 0.0 |
| DEX0455_040.nt.2 | 21501.02 | 41.2 | 41.2 | 53.8 | 53.8 | 0.0 | 0.0 |
| DEX0455_040.nt.2 | 21511.01 | 47.1 | 47.1 | 61.5 | 61.5 | 0.0 | 0.0 |
| DEX0455_040.nt.2 | 21511.02 | 47.1 | 47.1 | 53.8 | 53.8 | 25.0 | 25.0 |
| DEX0455_041.nt.1 | 12155.01 | 23.5 | 23.5 | 30.8 | 30.8 | 0.0 | 0.0 |
| DEX0455_041.nt.1 | 12155.02 | 23.5 | 23.5 | 30.8 | 30.8 | 0.0 | 0.0 |
| DEX0455_041.nt.1 | 16980.01 | 29.4 | 29.4 | 38.5 | 38.5 | 0.0 | 0.0 |
| DEX0455_041.nt.1 | 16980.02 | 29.4 | 29.4 | 38.5 | 38.5 | 0.0 | 0.0 |
| DEX0455_041.nt.2 | 12155.01 | 23.5 | 23.5 | 30.8 | 30.8 | 0.0 | 0.0 |
| DEX0455_041.nt.2 | 12155.02 | 23.5 | 23.5 | 30.8 | 30.8 | 0.0 | 0.0 |
| DEX0455_042.nt.1 | 18214.01 | 94.1 | 94.1 | 92.3 | 92.3 | 100.0 | 100.0 |
| DEX0455_042.nt.1 | 18214.02 | 88.2 | 93.8 | 84.6 | 91.7 | 100.0 | 100.0 |
| DEX0455_043.nt.1 | 14656.01 | 17.6 | 17.6 | 23.1 | 23.1 | 0.0 | 0.0 |
| DEX0455_043.nt.1 | 14656.02 | 17.6 | 17.6 | 23.1 | 23.1 | 0.0 | 0.0 |
| DEX0455_043.nt.3 | 14656.01 | 17.6 | 17.6 | 23.1 | 23.1 | 0.0 | 0.0 |
| DEX0455_043.nt.3 | 14656.02 | 17.6 | 17.6 | 23.1 | 23.1 | 0.0 | 0.0 |
| DEX0455_045.nt.1 | 36013.01 | 23.5 | 23.5 | 7.7 | 7.7 | 75.0 | 75.0 |
| DEX0455_045.nt.1 | 36013.02 | 11.8 | 11.8 | 0.0 | 0.0 | 50.0 | 50.0 |
| DEX0455_046.nt.1 | 17314.01 | 23.5 | 26.7 | 15.4 | 16.7 | 50.0 | 66.7 |
| DEX0455_046.nt.1 | 17314.02 | 23.5 | 26.7 | 15.4 | 16.7 | 50.0 | 66.7 |
| DEX0455_049.nt.1 | 11511.01 | 94.1 | 100.0 | 92.3 | 100.0 | 100.0 | 100.0 |
| DEX0455_049.nt.1 | 11511.02 | 88.2 | 100.0 | 84.6 | 100.0 | 100.0 | 100.0 |
| DEX0455_049.nt.2 | 11511.01 | 94.1 | 100.0 | 92.3 | 100.0 | 100.0 | 100.0 |
| DEX0455_049.nt.2 | 11511.02 | 88.2 | 100.0 | 84.6 | 100.0 | 100.0 | 100.0 |
| DEX0455_049.nt.4 | 11511.01 | 94.1 | 100.0 | 92.3 | 100.0 | 100.0 | 100.0 |
| DEX0455_049.nt.4 | 11511.02 | 88.2 | 100.0 | 84.6 | 100.0 | 100.0 | 100.0 |
| DEX0455_049.nt.5 | 11511.01 | 94.1 | 100.0 | 92.3 | 100.0 | 100.0 | 100.0 |

TABLE 1-continued

| DEX ID | Oligo Name | Ovr ALL % up n = 17 | Ovr ALL % valid up n = 17 | Ovr INV % up n = 13 | Ovr INV % valid up n = 13 | Ovr LMP % up n = 4 | Ovr LMP % valid up n = 4 |
|---|---|---|---|---|---|---|---|
| DEX0455_049.nt.5 | 11511.02 | 88.2 | 100.0 | 84.6 | 100.0 | 100.0 | 100.0 |
| DEX0455_050.nt.1 | 23378.01 | 11.8 | 18.2 | 15.4 | 20.0 | 0.0 | 0.0 |
| DEX0455_050.nt.1 | 23378.02 | 17.6 | 23.1 | 7.7 | 9.1 | 50.0 | 100.0 |
| DEX0455_052.nt.1 | 91971.01 | 94.1 | 94.1 | 92.3 | 92.3 | 100.0 | 100.0 |
| DEX0455_052.nt.1 | 91971.02 | 94.1 | 94.1 | 92.3 | 92.3 | 100.0 | 100.0 |
| DEX0455_055.nt.1 | 11273.01 | 23.5 | 23.5 | 30.8 | 30.8 | 0.0 | 0.0 |
| DEX0455_055.nt.1 | 11273.02 | 23.5 | 23.5 | 30.8 | 30.8 | 0.0 | 0.0 |
| DEX0455_055.nt.1 | 20541.01 | 17.6 | 17.6 | 23.1 | 23.1 | 0.0 | 0.0 |
| DEX0455_055.nt.1 | 20541.02 | 23.5 | 23.5 | 30.8 | 30.8 | 0.0 | 0.0 |
| DEX0455_055.nt.2 | 11273.01 | 23.5 | 23.5 | 30.8 | 30.8 | 0.0 | 0.0 |
| DEX0455_055.nt.2 | 11273.02 | 23.5 | 23.5 | 30.8 | 30.8 | 0.0 | 0.0 |
| DEX0455_055.nt.2 | 20541.01 | 17.6 | 17.6 | 23.1 | 23.1 | 0.0 | 0.0 |
| DEX0455_055.nt.2 | 20541.02 | 23.5 | 23.5 | 30.8 | 30.8 | 0.0 | 0.0 |
| DEX0455_055.nt.3 | 11273.01 | 23.5 | 23.5 | 30.8 | 30.8 | 0.0 | 0.0 |
| DEX0455_055.nt.3 | 11273.02 | 23.5 | 23.5 | 30.8 | 30.8 | 0.0 | 0.0 |
| DEX0455_055.nt.3 | 20541.01 | 17.6 | 17.6 | 23.1 | 23.1 | 0.0 | 0.0 |
| DEX0455_055.nt.3 | 20541.02 | 23.5 | 23.5 | 30.8 | 30.8 | 0.0 | 0.0 |
| DEX0455_056.nt.1 | 18520.01 | 23.5 | 23.5 | 30.8 | 30.8 | 0.0 | 0.0 |
| DEX0455_056.nt.1 | 18520.02 | 17.6 | 17.6 | 23.1 | 23.1 | 0.0 | 0.0 |
| DEX0455_056.nt.1 | 22734.01 | 5.9 | 5.9 | 7.7 | 7.7 | 0.0 | 0.0 |
| DEX0455_056.nt.1 | 22734.02 | 23.5 | 23.5 | 30.8 | 30.8 | 0.0 | 0.0 |
| DEX0455_056.nt.1 | 23444.01 | 0.0 | 0.0 | 0.0 | 0.0 | 0.0 | 0.0 |
| DEX0455_056.nt.1 | 23444.02 | 0.0 | 0.0 | 0.0 | 0.0 | 0.0 | 0.0 |
| DEX0455_056.nt.2 | 18520.01 | 23.5 | 23.5 | 30.8 | 30.8 | 0.0 | 0.0 |
| DEX0455_056.nt.2 | 18520.02 | 17.6 | 17.6 | 23.1 | 23.1 | 0.0 | 0.0 |
| DEX0455_056.nt.2 | 22734.01 | 5.9 | 5.9 | 7.7 | 7.7 | 0.0 | 0.0 |
| DEX0455_056.nt.2 | 22734.02 | 23.5 | 23.5 | 30.8 | 30.8 | 0.0 | 0.0 |
| DEX0455_056.nt.2 | 23444.01 | 0.0 | 0.0 | 0.0 | 0.0 | 0.0 | 0.0 |
| DEX0455_056.nt.2 | 23444.02 | 0.0 | 0.0 | 0.0 | 0.0 | 0.0 | 0.0 |
| DEX0455_057.nt.1 | 24524.01 | 70.6 | 70.6 | 69.2 | 69.2 | 75.0 | 75.0 |
| DEX0455_057.nt.1 | 24524.02 | 70.6 | 70.6 | 69.2 | 69.2 | 75.0 | 75.0 |
| DEX0455_057.nt.2 | 24524.01 | 70.6 | 70.6 | 69.2 | 69.2 | 75.0 | 75.0 |
| DEX0455_057.nt.2 | 24524.02 | 70.6 | 70.6 | 69.2 | 69.2 | 75.0 | 75.0 |
| DEX0455_058.nt.1 | 14656.01 | 17.6 | 17.6 | 23.1 | 23.1 | 0.0 | 0.0 |
| DEX0455_058.nt.1 | 14656.02 | 17.6 | 17.6 | 23.1 | 23.1 | 0.0 | 0.0 |
| DEX0455_059.nt.1 | 11469.01 | 47.1 | 47.1 | 61.5 | 61.5 | 0.0 | 0.0 |
| DEX0455_059.nt.1 | 11469.02 | 52.9 | 52.9 | 61.5 | 61.5 | 25.0 | 25.0 |
| DEX0455_059.nt.1 | 17370.01 | 5.9 | 25.0 | 7.7 | 25.0 | 0.0 | 0.0 |
| DEX0455_059.nt.1 | 17370.02 | 5.9 | 25.0 | 7.7 | 25.0 | 0.0 | 0.0 |
| DEX0455_059.nt.1 | 17372.01 | 0.0 | 0.0 | 0.0 | 0.0 | 0.0 | 0.0 |
| DEX0455_059.nt.1 | 17372.02 | 0.0 | 0.0 | 0.0 | 0.0 | 0.0 | 0.0 |
| DEX0455_059.nt.2 | 11469.01 | 47.1 | 47.1 | 61.5 | 61.5 | 0.0 | 0.0 |
| DEX0455_059.nt.2 | 11469.02 | 52.9 | 52.9 | 61.5 | 61.5 | 25.0 | 25.0 |
| DEX0455_059.nt.2 | 17372.01 | 0.0 | 0.0 | 0.0 | 0.0 | 0.0 | 0.0 |
| DEX0455_059.nt.2 | 17372.02 | 0.0 | 0.0 | 0.0 | 0.0 | 0.0 | 0.0 |
| DEX0455_060.nt.1 | 10372.01 | 35.3 | 35.3 | 46.2 | 46.2 | 0.0 | 0.0 |
| DEX0455_060.nt.1 | 10372.02 | 35.3 | 35.3 | 46.2 | 46.2 | 0.0 | 0.0 |
| DEX0455_060.nt.1 | 18582.01 | 23.5 | 23.5 | 30.8 | 30.8 | 0.0 | 0.0 |
| DEX0455_060.nt.1 | 18582.02 | 29.4 | 29.4 | 38.5 | 38.5 | 0.0 | 0.0 |
| DEX0455_061.nt.1 | 96523.01 | 23.5 | 23.5 | 15.4 | 15.4 | 50.0 | 50.0 |
| DEX0455_061.nt.1 | 96523.02 | 17.6 | 17.6 | 7.7 | 7.7 | 50.0 | 50.0 |
| DEX0455_061.nt.1 | 103529.01 | 23.5 | 25.0 | 15.4 | 16.7 | 50.0 | 50.0 |
| DEX0455_061.nt.1 | 103529.02 | 23.5 | 23.5 | 15.4 | 15.4 | 50.0 | 50.0 |
| DEX0455_061.nt.2 | 96523.01 | 23.5 | 23.5 | 15.4 | 15.4 | 50.0 | 50.0 |
| DEX0455_061.nt.2 | 96523.02 | 17.6 | 17.6 | 7.7 | 7.7 | 50.0 | 50.0 |
| DEX0455_061.nt.2 | 103529.01 | 23.5 | 25.0 | 15.4 | 16.7 | 50.0 | 50.0 |
| DEX0455_061.nt.2 | 103529.02 | 23.5 | 23.5 | 15.4 | 15.4 | 50.0 | 50.0 |
| DEX0455_061.nt.3 | 96523.01 | 23.5 | 23.5 | 15.4 | 15.4 | 50.0 | 50.0 |
| DEX0455_061.nt.3 | 96523.02 | 17.6 | 17.6 | 7.7 | 7.7 | 50.0 | 50.0 |
| DEX0455_061.nt.3 | 103529.01 | 23.5 | 25.0 | 15.4 | 16.7 | 50.0 | 50.0 |
| DEX0455_061.nt.3 | 103529.02 | 23.5 | 23.5 | 15.4 | 15.4 | 50.0 | 50.0 |
| DEX0455_061.nt.4 | 96523.01 | 23.5 | 23.5 | 15.4 | 15.4 | 50.0 | 50.0 |
| DEX0455_061.nt.4 | 96523.02 | 17.6 | 17.6 | 7.7 | 7.7 | 50.0 | 50.0 |
| DEX0455_061.nt.4 | 103529.01 | 23.5 | 25.0 | 15.4 | 16.7 | 50.0 | 50.0 |
| DEX0455_061.nt.4 | 103529.02 | 23.5 | 23.5 | 15.4 | 15.4 | 50.0 | 50.0 |
| DEX0455_061.nt.5 | 96523.01 | 23.5 | 23.5 | 15.4 | 15.4 | 50.0 | 50.0 |
| DEX0455_061.nt.5 | 96523.02 | 17.6 | 17.6 | 7.7 | 7.7 | 50.0 | 50.0 |
| DEX0455_061.nt.5 | 103529.01 | 23.5 | 25.0 | 15.4 | 16.7 | 50.0 | 50.0 |
| DEX0455_061.nt.5 | 103529.02 | 23.5 | 23.5 | 15.4 | 15.4 | 50.0 | 50.0 |
| DEX0455_062.nt.1 | 17464.01 | 29.4 | 29.4 | 38.5 | 38.5 | 0.0 | 0.0 |
| DEX0455_062.nt.1 | 17464.02 | 29.4 | 29.4 | 38.5 | 38.5 | 0.0 | 0.0 |
| DEX0455_062.nt.1 | 18094.01 | 52.9 | 52.9 | 69.2 | 69.2 | 0.0 | 0.0 |
| DEX0455_062.nt.1 | 18094.02 | 52.9 | 52.9 | 69.2 | 69.2 | 0.0 | 0.0 |

TABLE 2

| DEX ID | Oligo Name | Ovr Multi-Cancer ALL % up n = 19 | Ovr Multi-Cancer ALL % valid up n = 19 | Ovr Multi-Cancer INV % up n = 14 | Ovr Multi-Cancer INV % valid up n = 14 | Ovr Multi-Cancer LMP % up n = 5 | Ovr Multi-Cancer LMP % valid up n = 5 |
|---|---|---|---|---|---|---|---|
| DEX0455__002.nt.1 | 79699.1 | 10.5 | 10.5 | 14.3 | 14.3 | 0.0 | 0.0 |
| DEX0455__002.nt.1 | 79700.0 | 10.5 | 10.5 | 14.3 | 14.3 | 0.0 | 0.0 |
| DEX0455__002.nt.1 | 79700.1 | 26.3 | 26.3 | 21.4 | 21.4 | 40.0 | 40.0 |
| DEX0455__004.nt.1 | 96339.0 | 0.0 | 0.0 | 0.0 | 0.0 | 0.0 | 0.0 |
| DEX0455__004.nt.1 | 96339.1 | 0.0 | 0.0 | 0.0 | 0.0 | 0.0 | 0.0 |
| DEX0455__004.nt.1 | 96340.0 | 0.0 | 0.0 | 0.0 | 0.0 | 0.0 | 0.0 |
| DEX0455__004.nt.1 | 96340.1 | 0.0 | 0.0 | 0.0 | 0.0 | 0.0 | 0.0 |
| DEX0455__004.nt.1 | 105991.1 | 0.0 | 0.0 | 0.0 | 0.0 | 0.0 | 0.0 |
| DEX0455__004.nt.1 | 105991.1 | 0.0 | 0.0 | 0.0 | 0.0 | 0.0 | 0.0 |
| DEX0455__004.nt.1 | 105992.0 | 0.0 | 0.0 | 0.0 | 0.0 | 0.0 | 0.0 |
| DEX0455__004.nt.1 | 105992.1 | 0.0 | 0.0 | 0.0 | 0.0 | 0.0 | 0.0 |
| DEX0455__004.nt.1 | 105996.0 | 21.1 | 21.1 | 28.6 | 28.6 | 0.0 | 0.0 |
| DEX0455__004.nt.1 | 105996.1 | 21.1 | 21.1 | 28.6 | 28.6 | 0.0 | 0.0 |
| DEX0455__004.nt.2 | 96339.0 | 0.0 | 0.0 | 0.0 | 0.0 | 0.0 | 0.0 |
| DEX0455__004.nt.2 | 96339.1 | 0.0 | 0.0 | 0.0 | 0.0 | 0.0 | 0.0 |
| DEX0455__004.nt.2 | 96340.0 | 0.0 | 0.0 | 0.0 | 0.0 | 0.0 | 0.0 |
| DEX0455__004.nt.2 | 96340.1 | 0.0 | 0.0 | 0.0 | 0.0 | 0.0 | 0.0 |
| DEX0455__004.nt.2 | 105991.0 | 0.0 | 0.0 | 0.0 | 0.0 | 0.0 | 0.0 |
| DEX0455__004.nt.2 | 105991.1 | 0.0 | 0.0 | 0.0 | 0.0 | 0.0 | 0.0 |
| DEX0455__004.nt.2 | 105992.0 | 0.0 | 0.0 | 0.0 | 0.0 | 0.0 | 0.0 |
| DEX0455__004.nt.2 | 105992.1 | 0.0 | 0.0 | 0.0 | 0.0 | 0.0 | 0.0 |
| DEX0455__004.nt.2 | 105996.0 | 21.1 | 21.1 | 28.6 | 28.6 | 0.0 | 0.0 |
| DEX0455__004.nt.2 | 105996.1 | 21.1 | 21.1 | 28.6 | 28.6 | 0.0 | 0.0 |
| DEX0455__011.nt.1 | 35317.0 | 31.6 | 42.9 | 14.3 | 20.0 | 80.0 | 100.0 |
| DEX0455__011.nt.1 | 35317.1 | 31.6 | 35.3 | 14.3 | 15.4 | 80.0 | 100.0 |
| DEX0455__012.nt.1 | 34334.0 | 89.5 | 89.5 | 85.7 | 85.7 | 100.0 | 100.0 |
| DEX0455__012.nt.1 | 34334.1 | 84.2 | 88.9 | 85.7 | 85.7 | 80.0 | 100.0 |
| DEX0455__012.nt.1 | 34335.0 | 94.7 | 100.0 | 92.9 | 100.0 | 100.0 | 100.0 |
| DEX0455__012.nt.1 | 34335.1 | 89.5 | 100.0 | 92.9 | 100.0 | 80.0 | 100.0 |
| DEX0455__012.nt.2 | 34334.0 | 89.5 | 89.5 | 85.7 | 85.7 | 100.0 | 100.0 |
| DEX0455__012.nt.2 | 34334.1 | 84.2 | 88.9 | 85.7 | 85.7 | 80.0 | 100.0 |
| DEX0455__012.nt.2 | 34335.0 | 94.7 | 100.0 | 92.9 | 100.0 | 100.0 | 100.0 |
| DEX0455__012.nt.2 | 34335.1 | 89.5 | 100.0 | 92.9 | 100.0 | 80.0 | 100.0 |
| DEX0455__017.nt.1 | 36482.0 | 31.6 | 42.9 | 28.6 | 40.0 | 40.0 | 50.0 |
| DEX0455__017.nt.1 | 36482.1 | 31.6 | 50.0 | 28.6 | 44.4 | 40.0 | 66.7 |
| DEX0455__033.nt.1 | 2023.0 | 21.1 | 23.5 | 28.6 | 30.8 | 0.0 | 0.0 |
| DEX0455__033.nt.1 | 5327.0 | 15.8 | 16.7 | 21.4 | 21.4 | 0.0 | 0.0 |
| DEX0455__033.nt.1 | 5328.0 | 10.5 | 11.1 | 14.3 | 14.3 | 0.0 | 0.0 |
| DEX0455__035.nt.1 | 78519.0 | 42.1 | 47.1 | 57.1 | 57.1 | 0.0 | 0.0 |
| DEX0455__035.nt.1 | 78519.1 | 47.4 | 52.9 | 64.3 | 69.2 | 0.0 | 0.0 |
| DEX0455__035.nt.1 | 78520.0 | 36.8 | 38.9 | 50.0 | 50.0 | 0.0 | 0.0 |
| DEX0455__035.nt.1 | 78520.1 | 42.1 | 44.4 | 57.1 | 57.1 | 0.0 | 0.0 |
| DEX0455__035.nt.2 | 78519.0 | 42.1 | 47.1 | 57.1 | 57.1 | 0.0 | 0.0 |
| DEX0455__035.nt.2 | 78519.1 | 47.4 | 52.9 | 64.3 | 69.2 | 0.0 | 0.0 |
| DEX0455__035.nt.2 | 78520.0 | 36.8 | 38.9 | 50.0 | 50.0 | 0.0 | 0.0 |
| DEX0455__035.nt.2 | 78520.1 | 42.1 | 44.4 | 57.1 | 57.1 | 0.0 | 0.0 |
| DEX0455__035.nt.3 | 78519.0 | 42.1 | 47.1 | 57.1 | 57.1 | 0.0 | 0.0 |
| DEX0455__035.nt.3 | 78519.1 | 47.4 | 52.9 | 64.3 | 69.2 | 0.0 | 0.0 |
| DEX0455__035.nt.3 | 78520.0 | 36.8 | 38.9 | 50.0 | 50.0 | 0.0 | 0.0 |
| DEX0455__035.nt.3 | 78520.1 | 42.1 | 44.4 | 57.1 | 57.1 | 0.0 | 0.0 |
| DEX0455__038.nt.1 | 23542.0 | 5.3 | 5.6 | 7.1 | 7.7 | 0.0 | 0.0 |
| DEX0455__038.nt.1 | 23542.1 | 10.5 | 10.5 | 14.3 | 14.3 | 0.0 | 0.0 |
| DEX0455__038.nt.1 | 23543.0 | 15.8 | 16.7 | 14.3 | 15.4 | 20.0 | 20.0 |
| DEX0455__038.nt.1 | 23543.1 | 21.1 | 21.1 | 21.4 | 21.4 | 20.0 | 20.0 |
| DEX0455__038.nt.2 | 23542.0 | 5.3 | 5.6 | 7.1 | 7.7 | 0.0 | 0.0 |
| DEX0455__038.nt.2 | 23542.1 | 10.5 | 10.5 | 14.3 | 14.3 | 0.0 | 0.0 |
| DEX0455__038.nt.2 | 23543.0 | 15.8 | 16.7 | 14.3 | 15.4 | 20.0 | 20.0 |
| DEX0455__038.nt.2 | 23543.1 | 21.1 | 21.1 | 21.4 | 21.4 | 20.0 | 20.0 |
| DEX0455__038.nt.3 | 23542.0 | 5.3 | 5.6 | 7.1 | 7.7 | 0.0 | 0.0 |
| DEX0455__038.nt.3 | 23542.1 | 10.5 | 10.5 | 14.3 | 14.3 | 0.0 | 0.0 |
| DEX0455__038.nt.3 | 23543.0 | 15.8 | 16.7 | 14.3 | 15.4 | 20.0 | 20.0 |
| DEX0455__038.nt.3 | 23543.1 | 21.1 | 21.1 | 21.4 | 21.4 | 20.0 | 20.0 |
| DEX0455__047.nt.1 | 96212.0 | 10.5 | 11.8 | 14.3 | 15.4 | 0.0 | 0.0 |
| DEX0455__047.nt.1 | 96212.1 | 5.3 | 5.9 | 7.1 | 7.7 | 0.0 | 0.0 |
| DEX0455__047.nt.1 | 105764.0 | 10.5 | 12.5 | 14.3 | 15.4 | 0.0 | 0.0 |
| DEX0455__047.nt.1 | 105764.1 | 15.8 | 16.7 | 14.3 | 15.4 | 20.0 | 20.0 |
| DEX0455__047.nt.1 | 105767.0 | 15.8 | 15.8 | 14.3 | 14.3 | 20.0 | 20.0 |
| DEX0455__047.nt.1 | 105767.1 | 15.8 | 15.8 | 14.3 | 14.3 | 20.0 | 20.0 |
| DEX0455__047.nt.1 | 105768.0 | 15.8 | 15.8 | 14.3 | 14.3 | 20.0 | 20.0 |
| DEX0455__047.nt.1 | 105768.1 | 21.1 | 22.2 | 21.4 | 23.1 | 20.0 | 20.0 |
| DEX0455__047.nt.2 | 96212.0 | 10.5 | 11.8 | 14.3 | 15.4 | 0.0 | 0.0 |
| DEX0455__047.nt.2 | 96212.1 | 5.3 | 5.9 | 7.1 | 7.7 | 0.0 | 0.0 |
| DEX0455__047.nt.2 | 105764.0 | 10.5 | 12.5 | 14.3 | 15.4 | 0.0 | 0.0 |

TABLE 2-continued

| DEX ID | Oligo Name | Ovr Multi-Cancer ALL % up n = 19 | Ovr Multi-Cancer ALL % valid up n = 19 | Ovr Multi-Cancer INV % up n = 14 | Ovr Multi-Cancer INV % valid up n = 14 | Ovr Multi-Cancer LMP % up n = 5 | Ovr Multi-Cancer LMP % valid up n = 5 |
|---|---|---|---|---|---|---|---|
| DEX0455_047.nt.2 | 105764.1 | 15.8 | 16.7 | 14.3 | 15.4 | 20.0 | 20.0 |
| DEX0455_047.nt.2 | 105767.0 | 15.8 | 15.8 | 14.3 | 14.3 | 20.0 | 20.0 |
| DEX0455_047.nt.2 | 105767.1 | 15.8 | 15.8 | 14.3 | 14.3 | 20.0 | 20.0 |
| DEX0455_047.nt.2 | 105768.0 | 15.8 | 15.8 | 14.3 | 14.3 | 20.0 | 20.0 |
| DEX0455_047.nt.2 | 105768.1 | 21.1 | 22.2 | 21.4 | 23.1 | 20.0 | 20.0 |
| DEX0455_048.nt.1 | 1168.0 | 10.5 | 10.5 | 14.3 | 14.3 | 0.0 | 0.0 |
| DEX0455_048.nt.2 | 1175.0 | 0.0 | 0.0 | 0.0 | 0.0 | 0.0 | 0.0 |
| DEX0455_050.nt.1 | 23378.0 | 5.3 | 5.3 | 7.1 | 7.1 | 0.0 | 0.0 |
| DEX0455_050.nt.1 | 23378.1 | 5.3 | 5.3 | 7.1 | 7.1 | 0.0 | 0.0 |
| DEX0455_050.nt.1 | 23379.0 | 0.0 | 0.0 | 0.0 | 0.0 | 0.0 | 0.0 |
| DEX0455_050.nt.1 | 23379.1 | 0.0 | 0.0 | 0.0 | 0.0 | 0.0 | 0.0 |
| DEX0455_050.nt.1 | 42007.0 | 0.0 | 0.0 | 0.0 | 0.0 | 0.0 | 0.0 |
| DEX0455_050.nt.1 | 42007.1 | 0.0 | 0.0 | 0.0 | 0.0 | 0.0 | 0.0 |
| DEX0455_050.nt.1 | 42007.2 | 0.0 | 0.0 | 0.0 | 0.0 | 0.0 | 0.0 |
| DEX0455_050.nt.1 | 42008.0 | 0.0 | 0.0 | 0.0 | 0.0 | 0.0 | 0.0 |
| DEX0455_050.nt.1 | 42008.1 | 0.0 | 0.0 | 0.0 | 0.0 | 0.0 | 0.0 |
| DEX0455_050.nt.1 | 42008.2 | 0.0 | 0.0 | 0.0 | 0.0 | 0.0 | 0.0 |
| DEX0455_061.nt.1 | 78508.0 | 21.1 | 21.1 | 21.4 | 21.4 | 20.0 | 20.0 |
| DEX0455_061.nt.1 | 78508.1 | 21.1 | 21.1 | 21.4 | 21.4 | 20.0 | 20.0 |
| DEX0455_061.nt.2 | 78508.0 | 21.1 | 21.1 | 21.4 | 21.4 | 20.0 | 20.0 |
| DEX0455_061.nt.2 | 78508.1 | 21.1 | 21.1 | 21.4 | 21.4 | 20.0 | 20.0 |
| DEX0455_061.nt.3 | 78508.0 | 21.1 | 21.1 | 21.4 | 21.4 | 20.0 | 20.0 |
| DEX0455_061.nt.3 | 78508.1 | 21.1 | 21.1 | 21.4 | 21.4 | 20.0 | 20.0 |
| DEX0455_061.nt.4 | 78508.0 | 21.1 | 21.1 | 21.4 | 21.4 | 20.0 | 20.0 |
| DEX0455_061.nt.4 | 78508.1 | 21.1 | 21.1 | 21.4 | 21.4 | 20.0 | 20.0 |
| DEX0455_061.nt.5 | 78508.0 | 21.1 | 21.1 | 21.4 | 21.4 | 20.0 | 20.0 |
| DEX0455_061.nt.5 | 78508.1 | 21.1 | 21.1 | 21.4 | 21.4 | 20.0 | 20.0 |

Breast Cancer Chips

For breast cancer two different chip designs were evaluated with overlapping sets of a total of 36 samples, comparing the expression patterns of breast cancer derived polyA+ RNA to polyA+ RNA isolated from a pool of 10 normal breast tissues. For the Breast Array Chip, all 36 samples (9 stage I cancers, 23 stage II cancers, 4 stage III cancers) were analyzed. These samples also represented 10 Grade 1/2 and 26 Grade 3 cancers. The histopathologic grades for cancer are classified as follows: GX, cannot be assessed; G1, well differentiated; G2, moderately differentiated; G3, poorly differentiated; and G4, undifferentiated. *AJCC Cancer Staging Handbook*, pp. 9, (5th Ed, 1998). Samples were further grouped based on the expression patterns of the known breast cancer associated genes Her2 and ERα (10 HER2 up, 26 HER2 not up, 20 ER up and 16 ER not up) and for the Multi-Cancer Array Chip, a subset of 20 of these samples (9 stage I cancers, 8 stage II cancers, 3 stage III cancers) were assessed.

The results for the statistically significant up-regulated genes on the Breast Array Chip are shown in Tables 3 and 4. The results for the statistically significant up-regulated genes on the Multi-Cancer Array Chip are shown in Table 5. The first two columns of each table contain information about the sequence itself (Seq ID, Oligo Name), the next columns show the results obtained for all ("ALL") breast cancer samples, cancers corresponding to stageI ("ST1"), stages II and III ("ST2,3"), grades 1 and 2 ("GR1,2"), grade 3 ("GR3"), cancers exhibiting up-regulation of Her2 ("HER2up") or ERα ("ERup") or those not exhibiting up-regulation of Her2 ("NOT HER2up") or ERα ("NOT ERup"). '% up' indicates the percentage of all experiments in which up-regulation of at least 2-fold was observed (n=36 for Colon Array Chip, n=20 for the Multi-Cancer Array Chip), '% valid up' indicates the percentage of experiments with valid expression values in which up-regulation of at least 2-fold was observed.

TABLE 3

| DEX ID | Oligo Name | Mam ALL % up n = 36 | Mam ALL % valid up n = 36 | Mam ST1 % up n = 9 | Mam ST1 % valid up n = 9 | Mam ST2,3 % up n = 27 | Mam ST2,3 % valid up n = 27 | Mam GR1,2 % up n = 10 | Mam GR1,2 % valid up n = 10 | Mam GR3 % up n = 26 | Mam GR3 % valid up n = 26 |
|---|---|---|---|---|---|---|---|---|---|---|---|
| DEX0455_010.nt.1 | 32151.0 | 22.2 | 22.2 | 44.4 | 44.4 | 14.8 | 14.8 | 10.0 | 10.0 | 26.9 | 26.9 |
| DEX0455_017.nt.1 | 28221.0 | 2.8 | 3.1 | 0.0 | 0.0 | 3.7 | 4.3 | 0.0 | 0.0 | 3.8 | 4.5 |
| DEX0455_022.nt.1 | 23280.0 | 11.1 | 11.8 | 11.1 | 11.1 | 11.1 | 12.0 | 10.0 | 10.0 | 11.5 | 12.5 |
| DEX0455_035.nt.3 | 21143.0 | 0.0 | 0.0 | 0.0 | 0.0 | 0.0 | 0.0 | 0.0 | 0.0 | 0.0 | 0.0 |
| DEX0455_035.nt.3 | 21144.0 | 0.0 | 0.0 | 0.0 | 0.0 | 0.0 | 0.0 | 0.0 | 0.0 | 0.0 | 0.0 |
| DEX0455_041.nt.1 | 16998.0 | 0.0 | 0.0 | 0.0 | 0.0 | 0.0 | 0.0 | 0.0 | 0.0 | 0.0 | 0.0 |
| DEX0455_046.nt.1 | 19072.0 | 11.1 | 11.4 | 0.0 | 0.0 | 14.8 | 15.4 | 20.0 | 20.0 | 7.7 | 8.0 |
| DEX0455_050.nt.1 | 22136.0 | 0.0 | 0.0 | 0.0 | 0.0 | 0.0 | 0.0 | 0.0 | 0.0 | 0.0 | 0.0 |
| DEX0455_050.nt.1 | 23378.0 | 0.0 | 0.0 | 0.0 | 0.0 | 0.0 | 0.0 | 0.0 | 0.0 | 0.0 | 0.0 |
| DEX0455_050.nt.1 | 23378.2 | 0.0 | 0.0 | 0.0 | 0.0 | 0.0 | 0.0 | 0.0 | 0.0 | 0.0 | 0.0 |
| DEX0455_050.nt.1 | 23379.0 | 5.6 | 5.7 | 0.0 | 0.0 | 7.4 | 7.7 | 0.0 | 0.0 | 7.7 | 8.0 |
| DEX0455_050.nt.1 | 23379.2 | 5.6 | 5.7 | 0.0 | 0.0 | 7.4 | 7.7 | 0.0 | 0.0 | 7.7 | 8.0 |

TABLE 3-continued

| DEX ID | Oligo Name | Mam ALL % up n = 36 | Mam ALL % valid up n = 36 | Mam ST1 % up n = 9 | Mam ST1 % valid up n = 9 | Mam ST2,3 % up n = 27 | Mam ST2,3 % valid up n = 27 | Mam GR1,2 % up n = 10 | Mam GR1,2 % valid up n = 10 | Mam GR3 % up n = 26 | Mam GR3 % valid up n = 26 |
|---|---|---|---|---|---|---|---|---|---|---|---|
| DEX0455__050.nt.1 | 29736.0 | 2.8 | 2.8 | 0.0 | 0.0 | 3.7 | 3.7 | 0.0 | 0.0 | 3.8 | 3.8 |
| DEX0455__054.nt.1 | 19799.0 | 8.3 | 8.3 | 0.0 | 0.0 | 11.1 | 11.1 | 0.0 | 0.0 | 11.5 | 11.5 |
| DEX0455__055.nt.1 | 12731.0 | 0.0 | 0.0 | 0.0 | 0.0 | 0.0 | 0.0 | 0.0 | 0.0 | 0.0 | 0.0 |
| DEX0455__055.nt.1 | 12732.0 | 0.0 | 0.0 | 0.0 | 0.0 | 0.0 | 0.0 | 0.0 | 0.0 | 0.0 | 0.0 |
| DEX0455__055.nt.2 | 12731.0 | 0.0 | 0.0 | 0.0 | 0.0 | 0.0 | 0.0 | 0.0 | 0.0 | 0.0 | 0.0 |
| DEX0455__055.nt.2 | 12732.0 | 0.0 | 0.0 | 0.0 | 0.0 | 0.0 | 0.0 | 0.0 | 0.0 | 0.0 | 0.0 |
| DEX0455__055.nt.3 | 12731.0 | 0.0 | 0.0 | 0.0 | 0.0 | 0.0 | 0.0 | 0.0 | 0.0 | 0.0 | 0.0 |
| DEX0455__055.nt.3 | 12732.0 | 0.0 | 0.0 | 0.0 | 0.0 | 0.0 | 0.0 | 0.0 | 0.0 | 0.0 | 0.0 |

TABLE 4

| DEX ID | Oligo Name | Mam HER2up % up n = 10 | Mam HER2up % valid up n = 10 | Mam NOT HER2up % up n = 26 | Mam NOT HER2up % valid up n = 26 | Mam ERup % up n = 20 | Mam ERup % valid up n = 20 | Mam NOT ERup % up n = 16 | Mam NOT ERup % valid up n = 16 |
|---|---|---|---|---|---|---|---|---|---|
| DEX0455__010.nt.1 | 32151.0 | 20.0 | 20.0 | 23.1 | 23.1 | 10.0 | 10.0 | 37.5 | 37.5 |
| DEX0455__017.nt.1 | 28221.0 | 10.0 | 11.1 | 0.0 | 0.0 | 0.0 | 0.0 | 6.2 | 8.3 |
| DEX0455__022.nt.1 | 23280.0 | 20.0 | 20.0 | 7.7 | 8.3 | 10.0 | 11.1 | 12.5 | 12.5 |
| DEX0455__035.nt.3 | 21143.0 | 0.0 | 0.0 | 0.0 | 0.0 | 0.0 | 0.0 | 0.0 | 0.0 |
| DEX0455__035.nt.3 | 21144.0 | 0.0 | 0.0 | 0.0 | 0.0 | 0.0 | 0.0 | 0.0 | 0.0 |
| DEX0455__041.nt.1 | 16998.0 | 0.0 | 0.0 | 0.0 | 0.0 | 0.0 | 0.0 | 0.0 | 0.0 |
| DEX0455__046.nt.1 | 19072.0 | 20.0 | 20.0 | 7.7 | 8.0 | 15.0 | 15.0 | 6.2 | 6.7 |
| DEX0455__050.nt.1 | 22136.0 | 0.0 | 0.0 | 0.0 | 0.0 | 0.0 | 0.0 | 0.0 | 0.0 |
| DEX0455__050.nt.1 | 23378.0 | 0.0 | 0.0 | 0.0 | 0.0 | 0.0 | 0.0 | 0.0 | 0.0 |
| DEX0455__050.nt.1 | 23378.2 | 0.0 | 0.0 | 0.0 | 0.0 | 0.0 | 0.0 | 0.0 | 0.0 |
| DEX0455__050.nt.1 | 23379.0 | 0.0 | 0.0 | 7.7 | 8.0 | 0.0 | 0.0 | 12.5 | 13.3 |
| DEX0455__050.nt.1 | 23379.2 | 0.0 | 0.0 | 7.7 | 8.0 | 0.0 | 0.0 | 12.5 | 13.3 |
| DEX0455__050.nt.1 | 29736.0 | 0.0 | 0.0 | 3.8 | 3.8 | 0.0 | 0.0 | 6.2 | 6.2 |
| DEX0455__054.nt.1 | 19799.0 | 10.0 | 10.0 | 7.7 | 7.7 | 10.0 | 10.0 | 6.2 | 6.2 |
| DEX0455__055.nt.1 | 12731.0 | 0.0 | 0.0 | 0.0 | 0.0 | 0.0 | 0.0 | 0.0 | 0.0 |
| DEX0455__055.nt.1 | 12732.0 | 0.0 | 0.0 | 0.0 | 0.0 | 0.0 | 0.0 | 0.0 | 0.0 |
| DEX0455__055.nt.2 | 12731.0 | 0.0 | 0.0 | 0.0 | 0.0 | 0.0 | 0.0 | 0.0 | 0.0 |
| DEX0455__055.nt.2 | 12732.0 | 0.0 | 0.0 | 0.0 | 0.0 | 0.0 | 0.0 | 0.0 | 0.0 |
| DEX0455__055.nt.3 | 12731.0 | 0.0 | 0.0 | 0.0 | 0.0 | 0.0 | 0.0 | 0.0 | 0.0 |
| DEX0455__055.nt.3 | 12732.0 | 0.0 | 0.0 | 0.0 | 0.0 | 0.0 | 0.0 | 0.0 | 0.0 |

TABLE 5

| DEX ID | Oligo Name | Mam Multi-Cancer ALL % up n = 20 | Mam Multi-Cancer ALL % valid up n = 20 | Mam Multi-Cancer ST1 % up n = 9 | Mam Multi-Cancer ST1 % valid up n = 9 | Mam Multi-Cancer ST2,3 % up n = 11 | Mam Multi-Cancer ST2,3 % valid up n = 11 |
|---|---|---|---|---|---|---|---|
| DEX0455__002.nt.1 | 79699.1 | 20.0 | 20.0 | 44.4 | 44.4 | 0.0 | 0.0 |
| DEX0455__002.nt.1 | 79700.0 | 10.0 | 10.0 | 22.2 | 22.2 | 0.0 | 0.0 |
| DEX0455__002.nt.1 | 79700.1 | 15.0 | 15.0 | 33.3 | 33.3 | 0.0 | 0.0 |
| DEX0455__004.nt.1 | 96339.0 | 0.0 | 0.0 | 0.0 | 0.0 | 0.0 | 0.0 |
| DEX0455__004.nt.1 | 96339.1 | 0.0 | 0.0 | 0.0 | 0.0 | 0.0 | 0.0 |
| DEX0455__004.nt.1 | 96340.0 | 0.0 | 0.0 | 0.0 | 0.0 | 0.0 | 0.0 |
| DEX0455__004.nt.1 | 96340.1 | 0.0 | 0.0 | 0.0 | 0.0 | 0.0 | 0.0 |
| DEX0455__004.nt.1 | 105991.0 | 0.0 | 0.0 | 0.0 | 0.0 | 0.0 | 0.0 |
| DEX0455__004.nt.1 | 105991.1 | 0.0 | 0.0 | 0.0 | 0.0 | 0.0 | 0.0 |
| DEX0455__004.nt.1 | 105992.0 | 0.0 | 0.0 | 0.0 | 0.0 | 0.0 | 0.0 |
| DEX0455__004.nt.1 | 105992.1 | 0.0 | 0.0 | 0.0 | 0.0 | 0.0 | 0.0 |
| DEX0455__004.nt.1 | 105996.0 | 15.0 | 15.0 | 11.1 | 11.1 | 18.2 | 18.2 |
| DEX0455__004.nt.1 | 105996.1 | 15.0 | 15.0 | 11.1 | 11.1 | 18.2 | 18.2 |
| DEX0455__004.nt.2 | 96339.0 | 0.0 | 0.0 | 0.0 | 0.0 | 0.0 | 0.0 |
| DEX0455__004.nt.2 | 96339.1 | 0.0 | 0.0 | 0.0 | 0.0 | 0.0 | 0.0 |
| DEX0455__004.nt.2 | 96340.0 | 0.0 | 0.0 | 0.0 | 0.0 | 0.0 | 0.0 |
| DEX0455__004.nt.2 | 96340.1 | 0.0 | 0.0 | 0.0 | 0.0 | 0.0 | 0.0 |
| DEX0455__004.nt.2 | 105991.0 | 0.0 | 0.0 | 0.0 | 0.0 | 0.0 | 0.0 |
| DEX0455__004.nt.2 | 105991.1 | 0.0 | 0.0 | 0.0 | 0.0 | 0.0 | 0.0 |
| DEX0455__004.nt.2 | 105992.0 | 0.0 | 0.0 | 0.0 | 0.0 | 0.0 | 0.0 |
| DEX0455__004.nt.2 | 105992.1 | 0.0 | 0.0 | 0.0 | 0.0 | 0.0 | 0.0 |

TABLE 5-continued

| DEX ID | Oligo Name | Mam Multi-Cancer ALL % up n = 20 | Mam Multi-Cancer ALL % valid up n = 20 | Mam Multi-Cancer ST1 % up n = 9 | Mam Multi-Cancer ST1 % valid up n = 9 | Mam Multi-Cancer ST2,3 % up n = 11 | Mam Multi-Cancer ST2,3 % valid up n = 11 |
|---|---|---|---|---|---|---|---|
| DEX0455_004.nt.2 | 105996.0 | 15.0 | 15.0 | 11.1 | 11.1 | 18.2 | 18.2 |
| DEX0455_004.nt.2 | 105996.1 | 15.0 | 15.0 | 11.1 | 11.1 | 18.2 | 18.2 |
| DEX0455_011.nt.1 | 35317.0 | 5.0 | 7.1 | 11.1 | 20.0 | 0.0 | 0.0 |
| DEX0455_011.nt.1 | 35317.1 | 5.0 | 7.1 | 11.1 | 20.0 | 0.0 | 0.0 |
| DEX0455_012.nt.1 | 34334.0 | 5.0 | 5.0 | 0.0 | 0.0 | 9.1 | 9.1 |
| DEX0455_012.nt.1 | 34334.1 | 5.0 | 5.0 | 0.0 | 0.0 | 9.1 | 9.1 |
| DEX0455_012.nt.1 | 34335.0 | 5.0 | 5.0 | 0.0 | 0.0 | 9.1 | 9.1 |
| DEX0455_012.nt.1 | 34335.1 | 0.0 | 0.0 | 0.0 | 0.0 | 0.0 | 0.0 |
| DEX0455_012.nt.2 | 34334.0 | 5.0 | 5.0 | 0.0 | 0.0 | 9.1 | 9.1 |
| DEX0455_012.nt.2 | 34334.1 | 5.0 | 5.0 | 0.0 | 0.0 | 9.1 | 9.1 |
| DEX0455_012.nt.2 | 34335.0 | 5.0 | 5.0 | 0.0 | 0.0 | 9.1 | 9.1 |
| DEX0455_012.nt.2 | 34335.1 | 0.0 | 0.0 | 0.0 | 0.0 | 0.0 | 0.0 |
| DEX0455_017.nt.1 | 36482.0 | 10.0 | 10.0 | 11.1 | 11.1 | 9.1 | 9.1 |
| DEX0455_017.nt.1 | 36482.1 | 10.0 | 10.0 | 11.1 | 11.1 | 9.1 | 9.1 |
| DEX0455_033.nt.1 | 2023.0 | 10.0 | 10.0 | 0.0 | 0.0 | 18.2 | 18.2 |
| DEX0455_033.nt.1 | 5327.0 | 10.0 | 10.0 | 0.0 | 0.0 | 18.2 | 18.2 |
| DEX0455_033.nt.1 | 5328.0 | 10.0 | 10.0 | 0.0 | 0.0 | 18.2 | 18.2 |
| DEX0455_035.nt.1 | 78519.0 | 50.0 | 50.0 | 66.7 | 66.7 | 36.4 | 36.4 |
| DEX0455_035.nt.1 | 78519.1 | 40.0 | 40.0 | 66.7 | 66.7 | 18.2 | 18.2 |
| DEX0455_035.nt.1 | 78520.0 | 20.0 | 20.0 | 33.3 | 33.3 | 9.1 | 9.1 |
| DEX0455_035.nt.1 | 78520.1 | 20.0 | 20.0 | 33.3 | 33.3 | 9.1 | 9.1 |
| DEX0455_035.nt.2 | 78519.0 | 50.0 | 50.0 | 66.7 | 66.7 | 36.4 | 36.4 |
| DEX0455_035.nt.2 | 78519.1 | 40.0 | 40.0 | 66.7 | 66.7 | 18.2 | 18.2 |
| DEX0455_035.nt.2 | 78520.0 | 20.0 | 20.0 | 33.3 | 33.3 | 9.1 | 9.1 |
| DEX0455_035.nt.2 | 78520.1 | 20.0 | 20.0 | 33.3 | 33.3 | 9.1 | 9.1 |
| DEX0455_035.nt.3 | 78519.0 | 50.0 | 50.0 | 66.7 | 66.7 | 36.4 | 36.4 |
| DEX0455_035.nt.3 | 78519.1 | 40.0 | 40.0 | 66.7 | 66.7 | 18.2 | 18.2 |
| DEX0455_035.nt.3 | 78520.0 | 20.0 | 20.0 | 33.3 | 33.3 | 9.1 | 9.1 |
| DEX0455_035.nt.3 | 78520.1 | 20.0 | 20.0 | 33.3 | 33.3 | 9.1 | 9.1 |
| DEX0455_038.nt.1 | 23542.0 | 0.0 | 0.0 | 0.0 | 0.0 | 0.0 | 0.0 |
| DEX0455_038.nt.1 | 23542.1 | 0.0 | 0.0 | 0.0 | 0.0 | 0.0 | 0.0 |
| DEX0455_038.nt.1 | 23543.0 | 0.0 | 0.0 | 0.0 | 0.0 | 0.0 | 0.0 |
| DEX0455_038.nt.1 | 23543.1 | 0.0 | 0.0 | 0.0 | 0.0 | 0.0 | 0.0 |
| DEX0455_038.nt.2 | 23542.0 | 0.0 | 0.0 | 0.0 | 0.0 | 0.0 | 0.0 |
| DEX0455_038.nt.2 | 23542.1 | 0.0 | 0.0 | 0.0 | 0.0 | 0.0 | 0.0 |
| DEX0455_038.nt.2 | 23543.0 | 0.0 | 0.0 | 0.0 | 0.0 | 0.0 | 0.0 |
| DEX0455_038.nt.2 | 23543.1 | 0.0 | 0.0 | 0.0 | 0.0 | 0.0 | 0.0 |
| DEX0455_038.nt.3 | 23542.0 | 0.0 | 0.0 | 0.0 | 0.0 | 0.0 | 0.0 |
| DEX0455_038.nt.3 | 23542.1 | 0.0 | 0.0 | 0.0 | 0.0 | 0.0 | 0.0 |
| DEX0455_038.nt.3 | 23543.0 | 0.0 | 0.0 | 0.0 | 0.0 | 0.0 | 0.0 |
| DEX0455_038.nt.3 | 23543.1 | 0.0 | 0.0 | 0.0 | 0.0 | 0.0 | 0.0 |
| DEX0455_047.nt.1 | 96212.0 | 0.0 | 0.0 | 0.0 | 0.0 | 0.0 | 0.0 |
| DEX0455_047.nt.1 | 96212.1 | 0.0 | 0.0 | 0.0 | 0.0 | 0.0 | 0.0 |
| DEX0455_047.nt.1 | 105764.0 | 0.0 | 0.0 | 0.0 | 0.0 | 0.0 | 0.0 |
| DEX0455_047.nt.1 | 105764.1 | 0.0 | 0.0 | 0.0 | 0.0 | 0.0 | 0.0 |
| DEX0455_047.nt.1 | 105767.0 | 0.0 | 0.0 | 0.0 | 0.0 | 0.0 | 0.0 |
| DEX0455_047.nt.1 | 105767.1 | 0.0 | 0.0 | 0.0 | 0.0 | 0.0 | 0.0 |
| DEX0455_047.nt.1 | 105768.0 | 0.0 | 0.0 | 0.0 | 0.0 | 0.0 | 0.0 |
| DEX0455_047.nt.1 | 105768.1 | 0.0 | 0.0 | 0.0 | 0.0 | 0.0 | 0.0 |
| DEX0455_047.nt.2 | 96212.0 | 0.0 | 0.0 | 0.0 | 0.0 | 0.0 | 0.0 |
| DEX0455_047.nt.2 | 96212.1 | 0.0 | 0.0 | 0.0 | 0.0 | 0.0 | 0.0 |
| DEX0455_047.nt.2 | 105764.0 | 0.0 | 0.0 | 0.0 | 0.0 | 0.0 | 0.0 |
| DEX0455_047.nt.2 | 105764.1 | 0.0 | 0.0 | 0.0 | 0.0 | 0.0 | 0.0 |
| DEX0455_047.nt.2 | 105767.0 | 0.0 | 0.0 | 0.0 | 0.0 | 0.0 | 0.0 |
| DEX0455_047.nt.2 | 105767.1 | 0.0 | 0.0 | 0.0 | 0.0 | 0.0 | 0.0 |
| DEX0455_047.nt.2 | 105768.0 | 0.0 | 0.0 | 0.0 | 0.0 | 0.0 | 0.0 |
| DEX0455_047.nt.2 | 105768.1 | 0.0 | 0.0 | 0.0 | 0.0 | 0.0 | 0.0 |
| DEX0455_048.nt.1 | 1168.0 | 0.0 | 0.0 | 0.0 | 0.0 | 0.0 | 0.0 |
| DEX0455_048.nt.2 | 1175.0 | 5.0 | 5.0 | 0.0 | 0.0 | 9.1 | 9.1 |
| DEX0455_050.nt.1 | 23378.0 | 0.0 | 0.0 | 0.0 | 0.0 | 0.0 | 0.0 |
| DEX0455_050.nt.1 | 23378.1 | 0.0 | 0.0 | 0.0 | 0.0 | 0.0 | 0.0 |
| DEX0455_050.nt.1 | 23379.0 | 0.0 | 0.0 | 0.0 | 0.0 | 0.0 | 0.0 |
| DEX0455_050.nt.1 | 23379.1 | 0.0 | 0.0 | 0.0 | 0.0 | 0.0 | 0.0 |
| DEX0455_050.nt.1 | 42007.0 | 0.0 | 0.0 | 0.0 | 0.0 | 0.0 | 0.0 |
| DEX0455_050.nt.1 | 42007.1 | 0.0 | 0.0 | 0.0 | 0.0 | 0.0 | 0.0 |
| DEX0455_050.nt.1 | 42007.2 | 0.0 | 0.0 | 0.0 | 0.0 | 0.0 | 0.0 |
| DEX0455_050.nt.1 | 42008.0 | 0.0 | 0.0 | 0.0 | 0.0 | 0.0 | 0.0 |
| DEX0455_050.nt.1 | 42008.1 | 0.0 | 0.0 | 0.0 | 0.0 | 0.0 | 0.0 |
| DEX0455_050.nt.1 | 42008.2 | 0.0 | 0.0 | 0.0 | 0.0 | 0.0 | 0.0 |
| DEX0455_061.nt.1 | 78508.0 | 0.0 | 0.0 | 0.0 | 0.0 | 0.0 | 0.0 |
| DEX0455_061.nt.1 | 78508.1 | 0.0 | 0.0 | 0.0 | 0.0 | 0.0 | 0.0 |
| DEX0455_061.nt.2 | 78508.0 | 0.0 | 0.0 | 0.0 | 0.0 | 0.0 | 0.0 |
| DEX0455_061.nt.2 | 78508.1 | 0.0 | 0.0 | 0.0 | 0.0 | 0.0 | 0.0 |

TABLE 5-continued

| DEX ID | Oligo Name | Mam Multi-Cancer ALL % up n = 20 | Mam Multi-Cancer ALL % valid up n = 20 | Mam Multi-Cancer ST1 % up n = 9 | Mam Multi-Cancer ST1 % valid up n = 9 | Mam Multi-Cancer ST2,3 % up n = 11 | Mam Multi-Cancer ST2,3 % valid up n = 11 |
|---|---|---|---|---|---|---|---|
| DEX0455_061.nt.3 | 78508.0 | 0.0 | 0.0 | 0.0 | 0.0 | 0.0 | 0.0 |
| DEX0455_061.nt.3 | 78508.1 | 0.0 | 0.0 | 0.0 | 0.0 | 0.0 | 0.0 |
| DEX0455_061.nt.4 | 78508.0 | 0.0 | 0.0 | 0.0 | 0.0 | 0.0 | 0.0 |
| DEX0455_061.nt.4 | 78508.1 | 0.0 | 0.0 | 0.0 | 0.0 | 0.0 | 0.0 |
| DEX0455_061.nt.5 | 78508.0 | 0.0 | 0.0 | 0.0 | 0.0 | 0.0 | 0.0 |
| DEX0455_061.nt.5 | 78508.1 | 0.0 | 0.0 | 0.0 | 0.0 | 0.0 | 0.0 |

Colon Cancer Chips

For colon cancer two different chip designs were evaluated with overlapping sets of a total of 38 samples, comparing the expression patterns of colon cancer derived polyA+ RNA to polyA+ RNA isolated from a pool of 7 normal colon tissues. For the Colon Array Chip all 38 samples (23 Ascending colon carcinomas and 15 Rectosigmoidal carcinomas including: 5 stage I cancers, 15 stage II cancers, 15 stage III and 2 stage IV cancers, as well as 28 Grade 1/2 and 10 Grade 3 cancers) were analyzed. The histopathologic grades for cancer are classified as follows: GX, cannot be assessed; G1, well differentiated; G2, Moderately differentiated; G3, poorly differentiated; and G4, undifferentiated. *AJCC Cancer Staging Handbook*, 5$^{th}$ Edition, 1998, page 9. For the Colon Array Chip analysis, samples were further divided into groups based on the expression pattern of the known colon cancer associated gene Thymidilate Synthase (TS) (13 TS up 25 TS not up). The association of TS with advanced colorectal cancer is well documented. Paradiso et al., *Br J Cancer* 82(3):560-7 (2000); Etienne et al., *J Clin Oncol*. 20(12):2832-43 (2002); Aschele et al. *Clin Cancer Res*. 6(12):4797-802 (2000). For the Multi-Cancer Array Chip a subset of 27 of these samples (14 Ascending colon carcinomas and 13 Rectosigmoidal carcinomas including: 3 stage I cancers, 9 stage II cancers, 13 stage III and 2 stage IV cancers) were assessed.

The results for the statistically significant up-regulated genes on the Colon Array Chip are shown in Tables 6 and 7. The results for the statistically significant up-regulated genes on the Multi-Cancer Array Chip are shown in Table 8.

The first two columns of each table contain information about the sequence itself (Seq ID, Oligo Name), the next columns show the results obtained for all ("ALL") the colon samples, ascending colon carcinomas ("ASC"), Rectosigmoidal carcinomas ("RS"), cancers corresponding to stages I and II ("ST1,2"), stages III and IV ("ST3,4"), grades 1 and 2 ("GR1,2"), grade 3 ("GR3"), cancers exhibiting up-regulation of the TS gene ("TSup") or those not exhibiting up-regulation of the TS gene ("NOT TSup"). '% up' indicates the percentage of all experiments in which up-regulation of at least 2-fold was observed n=38 for the Colon Array Chip (n=27 for the Multi-Cancer Array Chip), '% valid up' indicates the percentage of experiments with valid expression values in which up-regulation of at least 2-fold was observed.

TABLE 6

| DEX ID | Oligo Name | Cln ALL % up n = 38 | Cln ALL % valid up n = 38 | Cln ASC % up n = 23 | Cln ASC % valid up n = 23 | Cln RS % up n = 15 | Cln RS % valid up n = 15 | Cln ST1,2 % up n = 20 | Cln ST1,2 % valid up n = 20 | Cln ST3,4 % up n = 18 | Cln ST3,4 % valid up n = 18 |
|---|---|---|---|---|---|---|---|---|---|---|---|
| DEX0455_010.nt.1 | 37415.0 | 52.6 | 52.6 | 69.6 | 69.6 | 26.7 | 26.7 | 50.0 | 50.0 | 55.6 | 55.6 |
| DEX0455_011.nt.1 | 35317.0 | 0.0 | 0.0 | 0.0 | 0.0 | 0.0 | 0.0 | 0.0 | 0.0 | 0.0 | 0.0 |
| DEX0455_012.nt.1 | 34334.0 | 0.0 | 0.0 | 0.0 | 0.0 | 0.0 | 0.0 | 0.0 | 0.0 | 0.0 | 0.0 |
| DEX0455_012.nt.1 | 34335.0 | 0.0 | 0.0 | 0.0 | 0.0 | 0.0 | 0.0 | 0.0 | 0.0 | 0.0 | 0.0 |
| DEX0455_012.nt.1 | 34343.0 | 5.3 | 5.7 | 4.3 | 4.5 | 6.7 | 7.7 | 0.0 | 0.0 | 11.1 | 12.5 |
| DEX0455_012.nt.1 | 34368.0 | 7.9 | 7.9 | 8.7 | 8.7 | 6.7 | 6.7 | 5.0 | 5.0 | 11.1 | 11.1 |
| DEX0455_012.nt.1 | 34369.0 | 7.9 | 7.9 | 8.7 | 8.7 | 6.7 | 6.7 | 5.0 | 5.0 | 11.1 | 11.1 |
| DEX0455_012.nt.2 | 34334.0 | 0.0 | 0.0 | 0.0 | 0.0 | 0.0 | 0.0 | 0.0 | 0.0 | 0.0 | 0.0 |
| DEX0455_012.nt.2 | 34335.0 | 0.0 | 0.0 | 0.0 | 0.0 | 0.0 | 0.0 | 0.0 | 0.0 | 0.0 | 0.0 |
| DEX0455_012.nt.2 | 34343.0 | 5.3 | 5.7 | 4.3 | 4.5 | 6.7 | 7.7 | 0.0 | 0.0 | 11.1 | 12.5 |
| DEX0455_012.nt.2 | 34368.0 | 7.9 | 7.9 | 8.7 | 8.7 | 6.7 | 6.7 | 5.0 | 5.0 | 11.1 | 11.1 |
| DEX0455_012.nt.2 | 34369.0 | 7.9 | 7.9 | 8.7 | 8.7 | 6.7 | 6.7 | 5.0 | 5.0 | 11.1 | 11.1 |
| DEX0455_017.nt.1 | 21032.0 | 0.0 | 0.0 | 0.0 | 0.0 | 0.0 | 0.0 | 0.0 | 0.0 | 0.0 | 0.0 |
| DEX0455_024.nt.1 | 17957.0 | 5.3 | 5.3 | 4.3 | 4.3 | 6.7 | 6.7 | 0.0 | 0.0 | 11.1 | 11.1 |
| DEX0455_028.nt.1 | 30821.0 | 2.6 | 2.6 | 0.0 | 0.0 | 6.7 | 6.7 | 5.0 | 5.0 | 0.0 | 0.0 |
| DEX0455_028.nt.1 | 41120.0 | 0.0 | 0.0 | 0.0 | 0.0 | 0.0 | 0.0 | 0.0 | 0.0 | 0.0 | 0.0 |
| DEX0455_029.nt.1 | 30820.0 | 2.6 | 2.6 | 0.0 | 0.0 | 6.7 | 6.7 | 5.0 | 5.0 | 0.0 | 0.0 |
| DEX0455_029.nt.1 | 30821.0 | 2.6 | 2.6 | 0.0 | 0.0 | 6.7 | 6.7 | 5.0 | 5.0 | 0.0 | 0.0 |
| DEX0455_029.nt.1 | 30824.0 | 7.9 | 7.9 | 8.7 | 8.7 | 6.7 | 6.7 | 10.0 | 10.0 | 5.6 | 5.6 |
| DEX0455_029.nt.1 | 30869.0 | 18.4 | 18.4 | 17.4 | 17.4 | 20.0 | 20.0 | 15.0 | 15.0 | 22.2 | 22.2 |
| DEX0455_029.nt.1 | 41117.0 | 0.0 | 0.0 | 0.0 | 0.0 | 0.0 | 0.0 | 0.0 | 0.0 | 0.0 | 0.0 |
| DEX0455_029.nt.1 | 41120.0 | 0.0 | 0.0 | 0.0 | 0.0 | 0.0 | 0.0 | 0.0 | 0.0 | 0.0 | 0.0 |
| DEX0455_029.nt.1 | 41151.0 | 10.5 | 10.5 | 13.0 | 13.0 | 6.7 | 6.7 | 15.0 | 15.0 | 5.6 | 5.6 |
| DEX0455_029.nt.1 | 41152.0 | 2.6 | 2.6 | 0.0 | 0.0 | 6.7 | 6.7 | 5.0 | 5.0 | 0.0 | 0.0 |
| DEX0455_029.nt.2 | 30820.0 | 2.6 | 2.6 | 0.0 | 0.0 | 6.7 | 6.7 | 5.0 | 5.0 | 0.0 | 0.0 |
| DEX0455_029.nt.2 | 30821.0 | 2.6 | 2.6 | 0.0 | 0.0 | 6.7 | 6.7 | 5.0 | 5.0 | 0.0 | 0.0 |
| DEX0455_029.nt.2 | 30824.0 | 7.9 | 7.9 | 8.7 | 8.7 | 6.7 | 6.7 | 10.0 | 10.0 | 5.6 | 5.6 |
| DEX0455_029.nt.2 | 30922.0 | 10.5 | 10.5 | 13.0 | 13.0 | 6.7 | 6.7 | 15.0 | 15.0 | 5.6 | 5.6 |

TABLE 6-continued

| DEX ID | Oligo Name | Cln ALL % up n = 38 | Cln ALL % valid up n = 38 | Cln ASC % up n = 23 | Cln ASC % valid up n = 23 | Cln RS % up n = 15 | Cln RS % valid up n = 15 | Cln ST1,2 % up n = 20 | Cln ST1,2 % valid up n = 20 | Cln ST3,4 % up n = 18 | Cln ST3,4 % valid up n = 18 |
|---|---|---|---|---|---|---|---|---|---|---|---|
| DEX0455_029.nt.2 | 41117.0 | 0.0 | 0.0 | 0.0 | 0.0 | 0.0 | 0.0 | 0.0 | 0.0 | 0.0 | 0.0 |
| DEX0455_029.nt.2 | 41120.0 | 0.0 | 0.0 | 0.0 | 0.0 | 0.0 | 0.0 | 0.0 | 0.0 | 0.0 | 0.0 |
| DEX0455_029.nt.2 | 41151.0 | 10.5 | 10.5 | 13.0 | 13.0 | 6.7 | 6.7 | 15.0 | 15.0 | 5.6 | 5.6 |
| DEX0455_029.nt.2 | 41152.0 | 2.6 | 2.6 | 0.0 | 0.0 | 6.7 | 6.7 | 5.0 | 5.0 | 0.0 | 0.0 |
| DEX0455_034.nt.1 | 16423.0 | 2.6 | 3.1 | 0.0 | 0.0 | 6.7 | 9.1 | 0.0 | 0.0 | 5.6 | 6.2 |
| DEX0455_049.nt.1 | 36902.0 | 2.6 | 2.6 | 4.3 | 4.3 | 0.0 | 0.0 | 0.0 | 0.0 | 5.6 | 5.6 |
| DEX0455_049.nt.2 | 36901.0 | 5.3 | 5.3 | 4.3 | 4.3 | 6.7 | 6.7 | 0.0 | 0.0 | 11.1 | 11.1 |
| DEX0455_049.nt.2 | 36902.0 | 2.6 | 2.6 | 4.3 | 4.3 | 0.0 | 0.0 | 0.0 | 0.0 | 5.6 | 5.6 |
| DEX0455_049.nt.3 | 36901.0 | 5.3 | 5.3 | 4.3 | 4.3 | 6.7 | 6.7 | 0.0 | 0.0 | 11.1 | 11.1 |
| DEX0455_049.nt.3 | 36902.0 | 2.6 | 2.6 | 4.3 | 4.3 | 0.0 | 0.0 | 0.0 | 0.0 | 5.6 | 5.6 |
| DEX0455_049.nt.4 | 36901.0 | 5.3 | 5.3 | 4.3 | 4.3 | 6.7 | 6.7 | 0.0 | 0.0 | 11.1 | 11.1 |
| DEX0455_049.nt.4 | 36902.0 | 2.6 | 2.6 | 4.3 | 4.3 | 0.0 | 0.0 | 0.0 | 0.0 | 5.6 | 5.6 |
| DEX0455_049.nt.5 | 36901.0 | 5.3 | 5.3 | 4.3 | 4.3 | 6.7 | 6.7 | 0.0 | 0.0 | 11.1 | 11.1 |
| DEX0455_049.nt.5 | 36902.0 | 2.6 | 2.6 | 4.3 | 4.3 | 0.0 | 0.0 | 0.0 | 0.0 | 5.6 | 5.6 |
| DEX0455_050.nt.1 | 23378.0 | 0.0 | 0.0 | 0.0 | 0.0 | 0.0 | 0.0 | 0.0 | 0.0 | 0.0 | 0.0 |
| DEX0455_050.nt.1 | 23378.1 | 0.0 | 0.0 | 0.0 | 0.0 | 0.0 | 0.0 | 0.0 | 0.0 | 0.0 | 0.0 |
| DEX0455_050.nt.1 | 23379.0 | 0.0 | 0.0 | 0.0 | 0.0 | 0.0 | 0.0 | 0.0 | 0.0 | 0.0 | 0.0 |
| DEX0455_050.nt.1 | 23379.1 | 0.0 | 0.0 | 0.0 | 0.0 | 0.0 | 0.0 | 0.0 | 0.0 | 0.0 | 0.0 |
| DEX0455_061.nt.1 | 19803.0 | 2.6 | 2.6 | 4.3 | 4.3 | 0.0 | 0.0 | 0.0 | 0.0 | 5.6 | 5.6 |
| DEX0455_061.nt.1 | 19804.0 | 5.3 | 5.3 | 4.3 | 4.3 | 6.7 | 6.7 | 0.0 | 0.0 | 11.1 | 11.1 |
| DEX0455_061.nt.2 | 19803.0 | 2.6 | 2.6 | 4.3 | 4.3 | 0.0 | 0.0 | 0.0 | 0.0 | 5.6 | 5.6 |
| DEX0455_061.nt.2 | 19804.0 | 5.3 | 5.3 | 4.3 | 4.3 | 6.7 | 6.7 | 0.0 | 0.0 | 11.1 | 11.1 |
| DEX0455_061.nt.3 | 19803.0 | 2.6 | 2.6 | 4.3 | 4.3 | 0.0 | 0.0 | 0.0 | 0.0 | 5.6 | 5.6 |
| DEX0455_061.nt.3 | 19804.0 | 5.3 | 5.3 | 4.3 | 4.3 | 6.7 | 6.7 | 0.0 | 0.0 | 11.1 | 11.1 |
| DEX0455_061.nt.4 | 19803.0 | 2.6 | 2.6 | 4.3 | 4.3 | 0.0 | 0.0 | 0.0 | 0.0 | 5.6 | 5.6 |
| DEX0455_061.nt.4 | 19804.0 | 5.3 | 5.3 | 4.3 | 4.3 | 6.7 | 6.7 | 0.0 | 0.0 | 11.1 | 11.1 |
| DEX0455_061.nt.5 | 19803.0 | 2.6 | 2.6 | 4.3 | 4.3 | 0.0 | 0.0 | 0.0 | 0.0 | 5.6 | 5.6 |
| DEX0455_061.nt.5 | 19804.0 | 5.3 | 5.3 | 4.3 | 4.3 | 6.7 | 6.7 | 0.0 | 0.0 | 11.1 | 11.1 |

TABLE 7

| DEX ID | Oligo Name | Cln GR1,2 % up n = 28 | Cln GR1,2 % valid up n = 28 | Cln GR3 % up n = 10 | Cln GR3 % valid up n = 10 | Cln TS up % up n = 13 | Cln TS up % valid up n = 13 | Cln NOT TS up % up n = 25 | Cln NOT TS up % valid up n = 25 |
|---|---|---|---|---|---|---|---|---|---|
| DEX0455_010.nt.1 | 37415.0 | 46.4 | 46.4 | 70.0 | 70.0 | 46.2 | 46.2 | 56.0 | 56.0 |
| DEX0455_011.nt.1 | 35317.0 | 0.0 | 0.0 | 0.0 | 0.0 | 0.0 | 0.0 | 0.0 | 0.0 |
| DEX0455_012.nt.1 | 34334.0 | 0.0 | 0.0 | 0.0 | 0.0 | 0.0 | 0.0 | 0.0 | 0.0 |
| DEX0455_012.nt.1 | 34335.0 | 0.0 | 0.0 | 0.0 | 0.0 | 0.0 | 0.0 | 0.0 | 0.0 |
| DEX0455_012.nt.1 | 34343.0 | 3.6 | 3.7 | 10.0 | 12.5 | 15.4 | 15.4 | 0.0 | 0.0 |
| DEX0455_012.nt.1 | 34368.0 | 7.1 | 7.1 | 10.0 | 10.0 | 15.4 | 15.4 | 4.0 | 4.0 |
| DEX0455_012.nt.1 | 34369.0 | 7.1 | 7.1 | 10.0 | 10.0 | 15.4 | 15.4 | 4.0 | 4.0 |
| DEX0455_012.nt.2 | 34334.0 | 0.0 | 0.0 | 0.0 | 0.0 | 0.0 | 0.0 | 0.0 | 0.0 |
| DEX0455_012.nt.2 | 34335.0 | 0.0 | 0.0 | 0.0 | 0.0 | 0.0 | 0.0 | 0.0 | 0.0 |
| DEX0455_012.nt.2 | 34343.0 | 3.6 | 3.7 | 10.0 | 12.5 | 15.4 | 15.4 | 0.0 | 0.0 |
| DEX0455_012.nt.2 | 34368.0 | 7.1 | 7.1 | 10.0 | 10.0 | 15.4 | 15.4 | 4.0 | 4.0 |
| DEX0455_012.nt.2 | 34369.0 | 7.1 | 7.1 | 10.0 | 10.0 | 15.4 | 15.4 | 4.0 | 4.0 |
| DEX0455_017.nt.1 | 21032.0 | 0.0 | 0.0 | 0.0 | 0.0 | 0.0 | 0.0 | 0.0 | 0.0 |
| DEX0455_024.nt.1 | 17957.0 | 7.1 | 7.1 | 0.0 | 0.0 | 7.7 | 7.7 | 4.0 | 4.0 |
| DEX0455_028.nt.1 | 30821.0 | 3.6 | 3.6 | 0.0 | 0.0 | 7.7 | 7.7 | 0.0 | 0.0 |
| DEX0455_028.nt.1 | 41120.0 | 0.0 | 0.0 | 0.0 | 0.0 | 0.0 | 0.0 | 0.0 | 0.0 |
| DEX0455_029.nt.1 | 30820.0 | 3.6 | 3.6 | 0.0 | 0.0 | 7.7 | 7.7 | 0.0 | 0.0 |
| DEX0455_029.nt.1 | 30821.0 | 3.6 | 3.6 | 0.0 | 0.0 | 7.7 | 7.7 | 0.0 | 0.0 |
| DEX0455_029.nt.1 | 30824.0 | 10.7 | 10.7 | 0.0 | 0.0 | 15.4 | 15.4 | 4.0 | 4.0 |
| DEX0455_029.nt.1 | 30869.0 | 17.9 | 17.9 | 20.0 | 20.0 | 30.8 | 30.8 | 12.0 | 12.0 |
| DEX0455_029.nt.1 | 41117.0 | 0.0 | 0.0 | 0.0 | 0.0 | 0.0 | 0.0 | 0.0 | 0.0 |
| DEX0455_029.nt.1 | 41120.0 | 0.0 | 0.0 | 0.0 | 0.0 | 0.0 | 0.0 | 0.0 | 0.0 |
| DEX0455_029.nt.1 | 41151.0 | 14.3 | 14.3 | 0.0 | 0.0 | 15.4 | 15.4 | 8.0 | 8.0 |
| DEX0455_029.nt.1 | 41152.0 | 3.6 | 3.6 | 0.0 | 0.0 | 7.7 | 7.7 | 0.0 | 0.0 |
| DEX0455_029.nt.2 | 30820.0 | 3.6 | 3.6 | 0.0 | 0.0 | 7.7 | 7.7 | 0.0 | 0.0 |
| DEX0455_029.nt.2 | 30821.0 | 3.6 | 3.6 | 0.0 | 0.0 | 7.7 | 7.7 | 0.0 | 0.0 |
| DEX0455_029.nt.2 | 30824.0 | 10.7 | 10.7 | 0.0 | 0.0 | 15.4 | 15.4 | 4.0 | 4.0 |
| DEX0455_029.nt.2 | 30922.0 | 14.3 | 14.3 | 0.0 | 0.0 | 15.4 | 15.4 | 8.0 | 8.0 |
| DEX0455_029.nt.2 | 41117.0 | 0.0 | 0.0 | 0.0 | 0.0 | 0.0 | 0.0 | 0.0 | 0.0 |
| DEX0455_029.nt.2 | 41120.0 | 0.0 | 0.0 | 0.0 | 0.0 | 0.0 | 0.0 | 0.0 | 0.0 |
| DEX0455_029.nt.2 | 41151.0 | 14.3 | 14.3 | 0.0 | 0.0 | 15.4 | 15.4 | 8.0 | 8.0 |
| DEX0455_029.nt.2 | 41152.0 | 3.6 | 3.6 | 0.0 | 0.0 | 7.7 | 7.7 | 0.0 | 0.0 |
| DEX0455_034.nt.1 | 16423.0 | 0.0 | 0.0 | 10.0 | 12.5 | 7.7 | 8.3 | 0.0 | 0.0 |

TABLE 7-continued

| DEX ID | Oligo Name | Cln GR1,2 % up n = 28 | Cln GR1,2 % valid up n = 28 | Cln GR3 % up n = 10 | Cln GR3 % valid up n = 10 | Cln TS up % up n = 13 | Cln TS up % valid up n = 13 | Cln NOT TS up % up n = 25 | Cln NOT TS up % valid up n = 25 |
|---|---|---|---|---|---|---|---|---|---|
| DEX0455_049.nt.1 | 36902.0 | 3.6 | 3.6 | 0.0 | 0.0 | 7.7 | 7.7 | 0.0 | 0.0 |
| DEX0455_049.nt.2 | 36901.0 | 3.6 | 3.6 | 10.0 | 10.0 | 15.4 | 15.4 | 0.0 | 0.0 |
| DEX0455_049.nt.2 | 36902.0 | 3.6 | 3.6 | 0.0 | 0.0 | 7.7 | 7.7 | 0.0 | 0.0 |
| DEX0455_049.nt.3 | 36901.0 | 3.6 | 3.6 | 10.0 | 10.0 | 15.4 | 15.4 | 0.0 | 0.0 |
| DEX0455_049.nt.3 | 36902.0 | 3.6 | 3.6 | 0.0 | 0.0 | 7.7 | 7.7 | 0.0 | 0.0 |
| DEX0455_049.nt.4 | 36901.0 | 3.6 | 3.6 | 10.0 | 10.0 | 15.4 | 15.4 | 0.0 | 0.0 |
| DEX0455_049.nt.4 | 36902.0 | 3.6 | 3.6 | 0.0 | 0.0 | 7.7 | 7.7 | 0.0 | 0.0 |
| DEX0455_049.nt.5 | 36901.0 | 3.6 | 3.6 | 10.0 | 10.0 | 15.4 | 15.4 | 0.0 | 0.0 |
| DEX0455_049.nt.5 | 36902.0 | 3.6 | 3.6 | 0.0 | 0.0 | 7.7 | 7.7 | 0.0 | 0.0 |
| DEX0455_050.nt.1 | 23378.0 | 0.0 | 0.0 | 0.0 | 0.0 | 0.0 | 0.0 | 0.0 | 0.0 |
| DEX0455_050.nt.1 | 23378.1 | 0.0 | 0.0 | 0.0 | 0.0 | 0.0 | 0.0 | 0.0 | 0.0 |
| DEX0455_050.nt.1 | 23379.0 | 0.0 | 0.0 | 0.0 | 0.0 | 0.0 | 0.0 | 0.0 | 0.0 |
| DEX0455_050.nt.1 | 23379.1 | 0.0 | 0.0 | 0.0 | 0.0 | 0.0 | 0.0 | 0.0 | 0.0 |
| DEX0455_061.nt.1 | 19803.0 | 0.0 | 0.0 | 10.0 | 10.0 | 0.0 | 0.0 | 4.0 | 4.0 |
| DEX0455_061.nt.1 | 19804.0 | 0.0 | 0.0 | 20.0 | 20.0 | 7.7 | 7.7 | 4.0 | 4.0 |
| DEX0455_061.nt.2 | 19803.0 | 0.0 | 0.0 | 10.0 | 10.0 | 0.0 | 0.0 | 4.0 | 4.0 |
| DEX0455_061.nt.2 | 19804.0 | 0.0 | 0.0 | 20.0 | 20.0 | 7.7 | 7.7 | 4.0 | 4.0 |
| DEX0455_061.nt.3 | 19803.0 | 0.0 | 0.0 | 10.0 | 10.0 | 0.0 | 0.0 | 4.0 | 4.0 |
| DEX0455_061.nt.3 | 19804.0 | 0.0 | 0.0 | 20.0 | 20.0 | 7.7 | 7.7 | 4.0 | 4.0 |
| DEX0455_061.nt.4 | 19803.0 | 0.0 | 0.0 | 10.0 | 10.0 | 0.0 | 0.0 | 4.0 | 4.0 |
| DEX0455_061.nt.4 | 19804.0 | 0.0 | 0.0 | 20.0 | 20.0 | 7.7 | 7.7 | 4.0 | 4.0 |
| DEX0455_061.nt.5 | 19803.0 | 0.0 | 0.0 | 10.0 | 10.0 | 0.0 | 0.0 | 4.0 | 4.0 |
| DEX0455_061.nt.5 | 19804.0 | 0.0 | 0.0 | 20.0 | 20.0 | 7.7 | 7.7 | 4.0 | 4.0 |

TABLE 8

| DEX ID | Oligo Name | Cln Multi-Cancer ALL % up n = 27 | Cln Multi-Cancer ALL % valid up n = 27 | Cln Multi-Cancer ASC % up n = 14 | Cln Multi-Cancer ASC % valid up n = 14 | Cln Multi-Cancer RS % up n = 13 | Cln Multi-Cancer RS % valid up n = 13 |
|---|---|---|---|---|---|---|---|
| DEX0455_002.nt.1 | 79699.1 | 0.0 | 0.0 | 0.0 | 0.0 | 0.0 | 0.0 |
| DEX0455_002.nt.1 | 79700.0 | 0.0 | 0.0 | 0.0 | 0.0 | 0.0 | 0.0 |
| DEX0455_002.nt.1 | 79700.1 | 0.0 | 0.0 | 0.0 | 0.0 | 0.0 | 0.0 |
| DEX0455_004.nt.1 | 96339.0 | 0.0 | 0.0 | 0.0 | 0.0 | 0.0 | 0.0 |
| DEX0455_004.nt.1 | 96339.1 | 7.4 | 33.3 | 14.3 | 66.7 | 0.0 | 0.0 |
| DEX0455_004.nt.1 | 96340.0 | 0.0 | 0.0 | 0.0 | 0.0 | 0.0 | 0.0 |
| DEX0455_004.nt.1 | 96340.1 | 0.0 | 0.0 | 0.0 | 0.0 | 0.0 | 0.0 |
| DEX0455_004.nt.1 | 105991.0 | 3.7 | 20.0 | 7.1 | 50.0 | 0.0 | 0.0 |
| DEX0455_004.nt.1 | 105991.1 | 3.7 | 25.0 | 7.1 | 33.3 | 0.0 | 0.0 |
| DEX0455_004.nt.1 | 105992.0 | 0.0 | 0.0 | 0.0 | 0.0 | 0.0 | 0.0 |
| DEX0455_004.nt.1 | 105992.1 | 0.0 | 0.0 | 0.0 | 0.0 | 0.0 | 0.0 |
| DEX0455_004.nt.1 | 105996.0 | 3.7 | 3.7 | 7.1 | 7.1 | 0.0 | 0.0 |
| DEX0455_004.nt.1 | 105996.1 | 7.4 | 7.4 | 7.1 | 7.1 | 7.7 | 7.7 |
| DEX0455_004.nt.2 | 96339.0 | 0.0 | 0.0 | 0.0 | 0.0 | 0.0 | 0.0 |
| DEX0455_004.nt.2 | 96339.1 | 7.4 | 33.3 | 14.3 | 66.7 | 0.0 | 0.0 |
| DEX0455_004.nt.2 | 96340.0 | 0.0 | 0.0 | 0.0 | 0.0 | 0.0 | 0.0 |
| DEX0455_004.nt.2 | 96340.1 | 0.0 | 0.0 | 0.0 | 0.0 | 0.0 | 0.0 |
| DEX0455_004.nt.2 | 105991.0 | 3.7 | 20.0 | 7.1 | 50.0 | 0.0 | 0.0 |
| DEX0455_004.nt.2 | 105991.1 | 3.7 | 25.0 | 7.1 | 33.3 | 0.0 | 0.0 |
| DEX0455_004.nt.2 | 105992.0 | 0.0 | 0.0 | 0.0 | 0.0 | 0.0 | 0.0 |
| DEX0455_004.nt.2 | 105992.1 | 0.0 | 0.0 | 0.0 | 0.0 | 0.0 | 0.0 |
| DEX0455_004.nt.2 | 105996.0 | 3.7 | 3.7 | 7.1 | 7.1 | 0.0 | 0.0 |
| DEX0455_004.nt.2 | 105996.1 | 7.4 | 7.4 | 7.1 | 7.1 | 7.7 | 7.7 |
| DEX0455_011.nt.1 | 35317.0 | 0.0 | 0.0 | 0.0 | 0.0 | 0.0 | 0.0 |
| DEX0455_011.nt.1 | 35317.1 | 0.0 | 0.0 | 0.0 | 0.0 | 0.0 | 0.0 |
| DEX0455_012.nt.1 | 34334.0 | 0.0 | 0.0 | 0.0 | 0.0 | 0.0 | 0.0 |
| DEX0455_012.nt.1 | 34334.1 | 0.0 | 0.0 | 0.0 | 0.0 | 0.0 | 0.0 |
| DEX0455_012.nt.1 | 34335.0 | 0.0 | 0.0 | 0.0 | 0.0 | 0.0 | 0.0 |
| DEX0455_012.nt.1 | 34335.1 | 0.0 | 0.0 | 0.0 | 0.0 | 0.0 | 0.0 |
| DEX0455_012.nt.2 | 34334.0 | 0.0 | 0.0 | 0.0 | 0.0 | 0.0 | 0.0 |
| DEX0455_012.nt.2 | 34334.1 | 0.0 | 0.0 | 0.0 | 0.0 | 0.0 | 0.0 |
| DEX0455_012.nt.2 | 34335.0 | 0.0 | 0.0 | 0.0 | 0.0 | 0.0 | 0.0 |
| DEX0455_012.nt.2 | 34335.1 | 0.0 | 0.0 | 0.0 | 0.0 | 0.0 | 0.0 |
| DEX0455_017.nt.1 | 36482.0 | 0.0 | 0.0 | 0.0 | 0.0 | 0.0 | 0.0 |
| DEX0455_017.nt.1 | 36482.1 | 0.0 | 0.0 | 0.0 | 0.0 | 0.0 | 0.0 |
| DEX0455_033.nt.1 | 2023.0 | 7.4 | 7.4 | 14.3 | 14.3 | 0.0 | 0.0 |
| DEX0455_033.nt.1 | 5327.0 | 3.7 | 3.8 | 7.1 | 7.7 | 0.0 | 0.0 |

TABLE 8-continued

| DEX ID | Oligo Name | Cln Multi-Cancer ALL % up n = 27 | Cln Multi-Cancer ALL % valid up n = 27 | Cln Multi-Cancer ASC % up n = 14 | Cln Multi-Cancer ASC % valid up n = 14 | Cln Multi-Cancer RS % up n = 13 | Cln Multi-Cancer RS % valid up n = 13 |
|---|---|---|---|---|---|---|---|
| DEX0455__033.nt.1 | 5328.0 | 3.7 | 3.7 | 7.1 | 7.1 | 0.0 | 0.0 |
| DEX0455__035.nt.1 | 78519.0 | 51.9 | 51.9 | 50.0 | 50.0 | 53.8 | 53.8 |
| DEX0455__035.nt.1 | 78519.1 | 44.4 | 46.2 | 42.9 | 46.2 | 46.2 | 46.2 |
| DEX0455__035.nt.1 | 78520.0 | 33.3 | 33.3 | 42.9 | 42.9 | 23.1 | 23.1 |
| DEX0455__035.nt.1 | 78520.1 | 33.3 | 33.3 | 42.9 | 42.9 | 23.1 | 23.1 |
| DEX0455__035.nt.2 | 78519.0 | 51.9 | 51.9 | 50.0 | 50.0 | 53.8 | 53.8 |
| DEX0455__035.nt.2 | 78519.1 | 44.4 | 46.2 | 42.9 | 46.2 | 46.2 | 46.2 |
| DEX0455__035.nt.2 | 78520.0 | 33.3 | 33.3 | 42.9 | 42.9 | 23.1 | 23.1 |
| DEX0455__035.nt.2 | 78520.1 | 33.3 | 33.3 | 42.9 | 42.9 | 23.1 | 23.1 |
| DEX0455__035.nt.3 | 78519.0 | 51.9 | 51.9 | 50.0 | 50.0 | 53.8 | 53.8 |
| DEX0455__035.nt.3 | 78519.1 | 44.4 | 46.2 | 42.9 | 46.2 | 46.2 | 46.2 |
| DEX0455__035.nt.3 | 78520.0 | 33.3 | 33.3 | 2.9 | 42.9 | 23.1 | 23.1 |
| DEX0455__035.nt.3 | 78520.1 | 33.3 | 33.3 | 42.9 | 42.9 | 23.1 | 23.1 |
| DEX0455__038.nt.1 | 23542.0 | 0.0 | 0.0 | 0.0 | 0.0 | 0.0 | 0.0 |
| DEX0455__038.nt.1 | 23542.1 | 0.0 | 0.0 | 0.0 | 0.0 | 0.0 | 0.0 |
| DEX0455__038.nt.1 | 23543.0 | 3.7 | 3.7 | 0.0 | 0.0 | 7.7 | 7.7 |
| DEX0455__038.nt.1 | 23543.1 | 3.7 | 3.7 | 0.0 | 0.0 | 7.7 | 7.7 |
| DEX0455__038.nt.2 | 23542.0 | 0.0 | 0.0 | 0.0 | 0.0 | 0.0 | 0.0 |
| DEX0455__038.nt.2 | 23542.1 | 0.0 | 0.0 | 0.0 | 0.0 | 0.0 | 0.0 |
| DEX0455__038.nt.2 | 23543.0 | 3.7 | 3.7 | 0.0 | 0.0 | 7.7 | 7.7 |
| DEX0455__038.nt.2 | 23543.1 | 3.7 | 3.7 | 0.0 | 0.0 | 7.7 | 7.7 |
| DEX0455__038.nt.3 | 23542.0 | 0.0 | 0.0 | 0.0 | 0.0 | 0.0 | 0.0 |
| DEX0455__038.nt.3 | 23542.1 | 0.0 | 0.0 | 0.0 | 0.0 | 0.0 | 0.0 |
| DEX0455__038.nt.3 | 23543.0 | 3.7 | 3.7 | 0.0 | 0.0 | 7.7 | 7.7 |
| DEX0455__038.nt.3 | 23543.1 | 3.7 | 3.7 | 0.0 | 0.0 | 7.7 | 7.7 |
| DEX0455__047.nt.1 | 96212.0 | 7.4 | 7.4 | 14.3 | 14.3 | 0.0 | 0.0 |
| DEX0455__047.nt.1 | 96212.1 | 7.4 | 7.4 | 14.3 | 14.3 | 0.0 | 0.0 |
| DEX0455__047.nt.1 | 105764.0 | 7.4 | 8.0 | 14.3 | 14.3 | 0.0 | 0.0 |
| DEX0455__047.nt.1 | 105764.1 | 7.4 | 7.4 | 14.3 | 14.3 | 0.0 | 0.0 |
| DEX0455__047.nt.1 | 105767.0 | 3.7 | 3.7 | 7.1 | 7.1 | 0.0 | 0.0 |
| DEX0455__047.nt.1 | 105767.1 | 0.0 | 0.0 | 0.0 | 0.0 | 0.0 | 0.0 |
| DEX0455__047.nt.1 | 105768.0 | 0.0 | 0.0 | 0.0 | 0.0 | 0.0 | 0.0 |
| DEX0455__047.nt.1 | 105768.1 | 0.0 | 0.0 | 0.0 | 0.0 | 0.0 | 0.0 |
| DEX0455__047.nt.2 | 96212.0 | 7.4 | 7.4 | 14.3 | 14.3 | 0.0 | 0.0 |
| DEX0455__047.nt.2 | 96212.1 | 7.4 | 7.4 | 14.3 | 14.3 | 0.0 | 0.0 |
| DEX0455__047.nt.2 | 105764.0 | 7.4 | 8.0 | 14.3 | 14.3 | 0.0 | 0.0 |
| DEX0455__047.nt.2 | 105764.1 | 7.4 | 7.4 | 14.3 | 14.3 | 0.0 | 0.0 |
| DEX0455__047.nt.2 | 105767.0 | 3.7 | 3.7 | 7.1 | 7.1 | 0.0 | 0.0 |
| DEX0455__047.nt.2 | 105767.1 | 0.0 | 0.0 | 0.0 | 0.0 | 0.0 | 0.0 |
| DEX0455__047.nt.2 | 105768.0 | 0.0 | 0.0 | 0.0 | 0.0 | 0.0 | 0.0 |
| DEX0455__047.nt.2 | 105768.1 | 0.0 | 0.0 | 0.0 | 0.0 | 0.0 | 0.0 |
| DEX0455__048.nt.1 | 1168.0 | 3.7 | 3.7 | 0.0 | 0.0 | 7.7 | 7.7 |
| DEX0455__048.nt.2 | 1175.0 | 3.7 | 4.0 | 7.1 | 7.7 | 0.0 | 0.0 |
| DEX0455__050.nt.1 | 23378.0 | 0.0 | 0.0 | 0.0 | 0.0 | 0.0 | 0.0 |
| DEX0455__050.nt.1 | 23378.1 | 0.0 | 0.0 | 0.0 | 0.0 | 0.0 | 0.0 |
| DEX0455__050.nt.1 | 23379.0 | 0.0 | 0.0 | 0.0 | 0.0 | 0.0 | 0.0 |
| DEX0455__050.nt.1 | 23379.1 | 0.0 | 0.0 | 0.0 | 0.0 | 0.0 | 0.0 |
| DEX0455__050.nt.1 | 42007.0 | 0.0 | 0.0 | 0.0 | 0.0 | 0.0 | 0.0 |
| DEX0455__050.nt.1 | 42007.1 | 0.0 | 0.0 | 0.0 | 0.0 | 0.0 | 0.0 |
| DEX0455__050.nt.1 | 42007.2 | 0.0 | 0.0 | 0.0 | 0.0 | 0.0 | 0.0 |
| DEX0455__050.nt.1 | 42008.0 | 0.0 | 0.0 | 0.0 | 0.0 | 0.0 | 0.0 |
| DEX0455__050.nt.1 | 42008.1 | 0.0 | 0.0 | 0.0 | 0.0 | 0.0 | 0.0 |
| DEX0455__050.nt.1 | 42008.2 | 0.0 | 0.0 | 0.0 | 0.0 | 0.0 | 0.0 |
| DEX0455__061.nt.1 | 78508.0 | 7.4 | 7.4 | 7.1 | 7.1 | 7.7 | 7.7 |
| DEX0455__061.nt.1 | 78508.1 | 7.4 | 7.4 | 7.1 | 7.1 | 7.7 | 7.7 |
| DEX0455__061.nt.2 | 78508.0 | 7.4 | 7.4 | 7.1 | 7.1 | 7.7 | 7.7 |
| DEX0455__061.nt.2 | 78508.1 | 7.4 | 7.4 | 7.1 | 7.1 | 7.7 | 7.7 |
| DEX0455__061.nt.3 | 78508.0 | 7.4 | 7.4 | 7.1 | 7.1 | 7.7 | 7.7 |
| DEX0455__061.nt.3 | 78508.1 | 7.4 | 7.4 | 7.1 | 7.1 | 7.7 | 7.7 |
| DEX0455__061.nt.4 | 78508.0 | 7.4 | 7.4 | 7.1 | 7.1 | 7.7 | 7.7 |
| DEX0455__061.nt.4 | 78508.1 | 7.4 | 7.4 | 7.1 | 7.1 | 7.7 | 7.7 |
| DEX0455__061.nt.5 | 78508.0 | 7.4 | 7.4 | 7.1 | 7.1 | 7.7 | 7.7 |
| DEX0455__061.nt.5 | 78508.1 | 7.4 | 7.4 | 7.1 | 7.1 | 7.7 | 7.7 |

Lung Cancer Chips

For lung cancer two different chip designs were evaluated with overlapping sets of a total of 29 samples, comparing the expression patterns of lung cancer derived polyA+RNA to polyA+ RNA isolated from a pool of 12 normal lung tissues. For the Lung Array Chip all 29 samples (15 squamous cell carcinomas and 14 adenocarcinomas including 14 stage I and 15 stage II/III cancers) were analyzed and for the Multi-Cancer Array Chip a subset of 22 of these samples (10 squamous cell carcinomas, 12 adenocarcinomas) were assessed.

The results for the statistically significant up-regulated genes on the Lung Array Chip are shown in Table 9. The results for the statistically significant up-regulated genes on the Multi-Cancer Array Chip are shown in Table 10. The first two columns of each table contain information about the sequence itself (DEX ID, Oligo Name), the next columns show the results obtained for all ("ALL") lung cancer samples, squamous cell carcinomas ("SQ"), adenocarcinomas ("AD"), or cancers corresponding to stage I ("ST1"), or stages II and III ("ST2,3"). '% up' indicates the percentage of all experiments in which up-regulation of at least 2-fold was observed (n=29 for Lung Array Chip, n=22 for Multi-Cancer Array Chip), '% valid up' indicates the percentage of experiments with valid expression values in which up-regulation of at least 2-fold was observed.

TABLE 9

| DEX ID | Oligo Name | Lng ALL % up n = 29 | Lng ALL % valid up n = 29 | Lng SQ % up n = 15 | Lng SQ % valid up n = 15 | Lng AD % up n = 14 | Lng AD % valid up n = 14 | Lng ST1 % up n = 14 | Lng ST1 % valid up n = 14 | Lng ST2,3 % up n = 15 | Lng ST2,3 % valid up n = 15 |
|---|---|---|---|---|---|---|---|---|---|---|---|
| DEX0455_010.nt.1 | 791.0 | 0.0 | 0.0 | 0.0 | 0.0 | 0.0 | 0.0 | 0.0 | 0.0 | 0.0 | 0.0 |
| DEX0455_010.nt.1 | 2720.0 | 0.0 | 0.0 | 0.0 | 0.0 | 0.0 | 0.0 | 0.0 | 0.0 | 0.0 | 0.0 |
| DEX0455_010.nt.1 | 2721.0 | 0.0 | 0.0 | 0.0 | 0.0 | 0.0 | 0.0 | 0.0 | 0.0 | 0.0 | 0.0 |
| DEX0455_010.nt.2 | 791.0 | 0.0 | 0.0 | 0.0 | 0.0 | 0.0 | 0.0 | 0.0 | 0.0 | 0.0 | 0.0 |
| DEX0455_010.nt.2 | 2720.0 | 0.0 | 0.0 | 0.0 | 0.0 | 0.0 | 0.0 | 0.0 | 0.0 | 0.0 | 0.0 |
| DEX0455_010.nt.2 | 2721.0 | 0.0 | 0.0 | 0.0 | 0.0 | 0.0 | 0.0 | 0.0 | 0.0 | 0.0 | 0.0 |
| DEX0455_032.nt.1 | 2688.0 | 0.0 | 0.0 | 0.0 | 0.0 | 0.0 | 0.0 | 0.0 | 0.0 | 0.0 | 0.0 |
| DEX0455_032.nt.1 | 2689.0 | 0.0 | 0.0 | 0.0 | 0.0 | 0.0 | 0.0 | 0.0 | 0.0 | 0.0 | 0.0 |
| DEX0455_032.nt.1 | 5313.0 | 0.0 | 0.0 | 0.0 | 0.0 | 0.0 | 0.0 | 0.0 | 0.0 | 0.0 | 0.0 |
| DEX0455_033.nt.1 | 2006.0 | 0.0 | 0.0 | 0.0 | 0.0 | 0.0 | 0.0 | 0.0 | 0.0 | 0.0 | 0.0 |
| DEX0455_033.nt.1 | 2007.0 | 0.0 | 0.0 | 0.0 | 0.0 | 0.0 | 0.0 | 0.0 | 0.0 | 0.0 | 0.0 |
| DEX0455_033.nt.1 | 2022.0 | 0.0 | 0.0 | 0.0 | 0.0 | 0.0 | 0.0 | 0.0 | 0.0 | 0.0 | 0.0 |
| DEX0455_033.nt.1 | 2032.0 | 0.0 | 0.0 | 0.0 | 0.0 | 0.0 | 0.0 | 0.0 | 0.0 | 0.0 | 0.0 |
| DEX0455_042.nt.1 | 889.0 | 93.1 | 93.1 | 100.0 | 100.0 | 85.7 | 85.7 | 92.9 | 92.9 | 93.3 | 93.3 |
| DEX0455_048.nt.1 | 1009.0 | 3.4 | 3.4 | 6.7 | 6.7 | 0.0 | 0.0 | 0.0 | 0.0 | 6.7 | 6.7 |
| DEX0455_048.nt.1 | 1010.0 | 6.9 | 6.9 | 13.3 | 13.3 | 0.0 | 0.0 | 0.0 | 0.0 | 13.3 | 13.3 |
| DEX0455_048.nt.1 | 1011.0 | 6.9 | 6.9 | 13.3 | 13.3 | 0.0 | 0.0 | 7.1 | 7.1 | 6.7 | 6.7 |
| DEX0455_048.nt.1 | 1169.0 | 3.4 | 3.4 | 6.7 | 6.7 | 0.0 | 0.0 | 0.0 | 0.0 | 6.7 | 6.7 |
| DEX0455_048.nt.2 | 1009.0 | 3.4 | 3.4 | 6.7 | 6.7 | 0.0 | 0.0 | 0.0 | 0.0 | 6.7 | 6.7 |
| DEX0455_048.nt.2 | 1010.0 | 6.9 | 6.9 | 13.3 | 13.3 | 0.0 | 0.0 | 0.0 | 0.0 | 13.3 | 13.3 |
| DEX0455_048.nt.2 | 1011.0 | 6.9 | 6.9 | 13.3 | 13.3 | 0.0 | 0.0 | 7.1 | 7.1 | 6.7 | 6.7 |
| DEX0455_048.nt.2 | 1169.0 | 3.4 | 3.4 | 6.7 | 6.7 | 0.0 | 0.0 | 0.0 | 0.0 | 6.7 | 6.7 |
| DEX0455_048.nt.2 | 1174.0 | 0.0 | 0.0 | 0.0 | 0.0 | 0.0 | 0.0 | 0.0 | 0.0 | 0.0 | 0.0 |
| DEX0455_050.nt.1 | 7815.0 | 0.0 | 0.0 | 0.0 | 0.0 | 0.0 | 0.0 | 0.0 | 0.0 | 0.0 | 0.0 |
| DEX0455_050.nt.1 | 23378.0 | 0.0 | 0.0 | 0.0 | 0.0 | 0.0 | 0.0 | 0.0 | 0.0 | 0.0 | 0.0 |
| DEX0455_050.nt.1 | 23378.2 | 0.0 | 0.0 | 0.0 | 0.0 | 0.0 | 0.0 | 0.0 | 0.0 | 0.0 | 0.0 |
| DEX0455_050.nt.1 | 42007.0 | 0.0 | 0.0 | 0.0 | 0.0 | 0.0 | 0.0 | 0.0 | 0.0 | 0.0 | 0.0 |
| DEX0455_050.nt.1 | 42008.0 | 0.0 | 0.0 | 0.0 | 0.0 | 0.0 | 0.0 | 0.0 | 0.0 | 0.0 | 0.0 |
| DEX0455_056.nt.1 | 1582.0 | 0.0 | 0.0 | 0.0 | 0.0 | 0.0 | 0.0 | 0.0 | 0.0 | 0.0 | 0.0 |
| DEX0455_056.nt.1 | 1583.0 | 0.0 | 0.0 | 0.0 | 0.0 | 0.0 | 0.0 | 0.0 | 0.0 | 0.0 | 0.0 |
| DEX0455_056.nt.1 | 2661.0 | 0.0 | 0.0 | 0.0 | 0.0 | 0.0 | 0.0 | 0.0 | 0.0 | 0.0 | 0.0 |
| DEX0455_056.nt.1 | 3143.0 | 0.0 | 0.0 | 0.0 | 0.0 | 0.0 | 0.0 | 0.0 | 0.0 | 0.0 | 0.0 |
| DEX0455_056.nt.1 | 3160.0 | 0.0 | 0.0 | 0.0 | 0.0 | 0.0 | 0.0 | 0.0 | 0.0 | 0.0 | 0.0 |
| DEX0455_056.nt.1 | 3161.0 | 0.0 | 0.0 | 0.0 | 0.0 | 0.0 | 0.0 | 0.0 | 0.0 | 0.0 | 0.0 |
| DEX0455_056.nt.1 | 3164.0 | 0.0 | 0.0 | 0.0 | 0.0 | 0.0 | 0.0 | 0.0 | 0.0 | 0.0 | 0.0 |
| DEX0455_056.nt.1 | 3165.0 | 0.0 | 0.0 | 0.0 | 0.0 | 0.0 | 0.0 | 0.0 | 0.0 | 0.0 | 0.0 |
| DEX0455_056.nt.2 | 1582.0 | 0.0 | 0.0 | 0.0 | 0.0 | 0.0 | 0.0 | 0.0 | 0.0 | 0.0 | 0.0 |
| DEX0455_056.nt.2 | 1583.0 | 0.0 | 0.0 | 0.0 | 0.0 | 0.0 | 0.0 | 0.0 | 0.0 | 0.0 | 0.0 |
| DEX0455_056.nt.2 | 2661.0 | 0.0 | 0.0 | 0.0 | 0.0 | 0.0 | 0.0 | 0.0 | 0.0 | 0.0 | 0.0 |
| DEX0455_056.nt.2 | 3160.0 | 0.0 | 0.0 | 0.0 | 0.0 | 0.0 | 0.0 | 0.0 | 0.0 | 0.0 | 0.0 |
| DEX0455_056.nt.2 | 3161.0 | 0.0 | 0.0 | 0.0 | 0.0 | 0.0 | 0.0 | 0.0 | 0.0 | 0.0 | 0.0 |
| DEX0455_056.nt.2 | 3164.0 | 0.0 | 0.0 | 0.0 | 0.0 | 0.0 | 0.0 | 0.0 | 0.0 | 0.0 | 0.0 |
| DEX0455_056.nt.2 | 3165.0 | 0.0 | 0.0 | 0.0 | 0.0 | 0.0 | 0.0 | 0.0 | 0.0 | 0.0 | 0.0 |
| DEX0455_057.nt.1 | 7612.0 | 0.0 | 0.0 | 0.0 | 0.0 | 0.0 | 0.0 | 0.0 | 0.0 | 0.0 | 0.0 |
| DEX0455_057.nt.1 | 7613.0 | 0.0 | 0.0 | 0.0 | 0.0 | 0.0 | 0.0 | 0.0 | 0.0 | 0.0 | 0.0 |
| DEX0455_057.nt.2 | 7612.0 | 0.0 | 0.0 | 0.0 | 0.0 | 0.0 | 0.0 | 0.0 | 0.0 | 0.0 | 0.0 |
| DEX0455_057.nt.2 | 7613.0 | 0.0 | 0.0 | 0.0 | 0.0 | 0.0 | 0.0 | 0.0 | 0.0 | 0.0 | 0.0 |

TABLE 10

| DEX ID | Oligo Name | Lng Multi-Cancer ALL % up n = 22 | Lng Multi-Cancer ALL % valid up n = 22 | Lng Multi-Cancer SQ % up n = 10 | Lng Multi-Cancer SQ % valid up n = 10 | Lng Multi-cancer AD % up n = 12 | Lng Multi-Cancer AD % valid up n = 12 |
|---|---|---|---|---|---|---|---|
| DEX0455_002.nt.1 | 79699.1 | 0.0 | 0.0 | 0.0 | 0.0 | 0.0 | 0.0 |
| DEX0455_002.nt.1 | 79700.0 | 0.0 | 0.0 | 0.0 | 0.0 | 0.0 | 0.0 |
| DEX0455_002.nt.1 | 79700.1 | 0.0 | 0.0 | 0.0 | 0.0 | 0.0 | 0.0 |
| DEX0455_004.nt.1 | 96339.0 | 0.0 | 0.0 | 0.0 | 0.0 | 0.0 | 0.0 |
| DEX0455_004.nt.1 | 96339.1 | 0.0 | 0.0 | 0.0 | 0.0 | 0.0 | 0.0 |
| DEX0455_004.nt.1 | 96340.0 | 0.0 | 0.0 | 0.0 | 0.0 | 0.0 | 0.0 |

TABLE 10-continued

| DEX ID | Oligo Name | Lng Multi-Cancer ALL % up n = 22 | Lng Multi-Cancer ALL % valid up n = 22 | Lng Multi-Cancer SQ % up n = 10 | Lng Multi-Cancer SQ % valid up n = 10 | Lng Multi-cancer AD % up n = 12 | Lng Multi-Cancer AD % valid up n = 12 |
|---|---|---|---|---|---|---|---|
| DEX0455_004.nt.1 | 96340.1 | 0.0 | 0.0 | 0.0 | 0.0 | 0.0 | 0.0 |
| DEX0455_004.nt.1 | 105991.0 | 0.0 | 0.0 | 0.0 | 0.0 | 0.0 | 0.0 |
| DEX0455_004.nt.1 | 105991.1 | 0.0 | 0.0 | 0.0 | 0.0 | 0.0 | 0.0 |
| DEX0455_004.nt.1 | 105992.0 | 0.0 | 0.0 | 0.0 | 0.0 | 0.0 | 0.0 |
| DEX0455_004.nt.1 | 105992.1 | 0.0 | 0.0 | 0.0 | 0.0 | 0.0 | 0.0 |
| DEX0455_004.nt.1 | 105996.0 | 0.0 | 0.0 | 0.0 | 0.0 | 0.0 | 0.0 |
| DEX0455_004.nt.1 | 105996.1 | 0.0 | 0.0 | 0.0 | 0.0 | 0.0 | 0.0 |
| DEX0455_004.nt.2 | 96339.0 | 0.0 | 0.0 | 0.0 | 0.0 | 0.0 | 0.0 |
| DEX0455_004.nt.2 | 96339.1 | 0.0 | 0.0 | 0.0 | 0.0 | 0.0 | 0.0 |
| DEX0455_004.nt.2 | 96340.0 | 0.0 | 0.0 | 0.0 | 0.0 | 0.0 | 0.0 |
| DEX0455_004.nt.2 | 96340.1 | 0.0 | 0.0 | 0.0 | 0.0 | 0.0 | 0.0 |
| DEX0455_004.nt.2 | 105991.0 | 0.0 | 0.0 | 0.0 | 0.0 | 0.0 | 0.0 |
| DEX0455_004.nt.2 | 105991.1 | 0.0 | 0.0 | 0.0 | 0.0 | 0.0 | 0.0 |
| DEX0455_004.nt.2 | 105992.0 | 0.0 | 0.0 | 0.0 | 0.0 | 0.0 | 0.0 |
| DEX0455_004.nt.2 | 105992.1 | 0.0 | 0.0 | 0.0 | 0.0 | 0.0 | 0.0 |
| DEX0455_004.nt.2 | 105996.0 | 0.0 | 0.0 | 0.0 | 0.0 | 0.0 | 0.0 |
| DEX0455_004.nt.2 | 105996.1 | 0.0 | 0.0 | 0.0 | 0.0 | 0.0 | 0.0 |
| DEX0455_011.nt.1 | 35317.0 | 9.1 | 13.3 | 0.0 | 0.0 | 16.7 | 18.2 |
| DEX0455_011.nt.1 | 35317.1 | 9.1 | 13.3 | 0.0 | 0.0 | 16.7 | 18.2 |
| DEX0455_012.nt.1 | 34334.0 | 13.6 | 13.6 | 10.0 | 10.0 | 16.7 | 16.7 |
| DEX0455_012.nt.1 | 34334.1 | 13.6 | 13.6 | 10.0 | 10.0 | 16.7 | 16.7 |
| DEX0455_012.nt.1 | 34335.0 | 13.6 | 13.6 | 10.0 | 10.0 | 16.7 | 16.7 |
| DEX0455_012.nt.1 | 34335.1 | 13.6 | 13.6 | 10.0 | 10.0 | 16.7 | 16.7 |
| DEX0455_012.nt.2 | 34334.0 | 13.6 | 13.6 | 10.0 | 10.0 | 16.7 | 16.7 |
| DEX0455_012.nt.2 | 34334.1 | 13.6 | 13.6 | 10.0 | 10.0 | 16.7 | 16.7 |
| DEX0455_012.nt.2 | 34335.0 | 13.6 | 13.6 | 10.0 | 10.0 | 16.7 | 16.7 |
| DEX0455_012.nt.2 | 34335.1 | 13.6 | 13.6 | 10.0 | 10.0 | 16.7 | 16.7 |
| DEX0455_017.nt.1 | 36482.0 | 4.5 | 4.5 | 0.0 | 0.0 | 8.3 | 8.3 |
| DEX0455_017.nt.1 | 36482.1 | 4.5 | 4.5 | 0.0 | 0.0 | 8.3 | 8.3 |
| DEX0455_033.nt.1 | 2023.0 | 4.5 | 4.5 | 10.0 | 10.0 | 0.0 | 0.0 |
| DEX0455_033.nt.1 | 5327.0 | 0.0 | 0.0 | 0.0 | 0.0 | 0.0 | 0.0 |
| DEX0455_033.nt.1 | 5328.0 | 0.0 | 0.0 | 0.0 | 0.0 | 0.0 | 0.0 |
| DEX0455_035.nt.1 | 78519.0 | 50.0 | 50.0 | 40.0 | 40.0 | 58.3 | 58.3 |
| DEX0455_035.nt.1 | 78519.1 | 50.0 | 50.0 | 40.0 | 40.0 | 58.3 | 58.3 |
| DEX0455_035.nt.1 | 78520.0 | 40.9 | 40.9 | 30.0 | 30.0 | 50.0 | 50.0 |
| DEX0455_035.nt.1 | 78520.1 | 45.5 | 45.5 | 40.0 | 40.0 | 50.0 | 50.0 |
| DEX0455_035.nt.2 | 78519.0 | 50.0 | 50.0 | 40.0 | 40.0 | 58.3 | 58.3 |
| DEX0455_035.nt.2 | 78519.1 | 50.0 | 50.0 | 40.0 | 40.0 | 58.3 | 58.3 |
| DEX0455_035.nt.2 | 78520.0 | 40.9 | 40.9 | 30.0 | 30.0 | 50.0 | 50.0 |
| DEX0455_035.nt.2 | 78520.1 | 45.5 | 45.5 | 40.0 | 40.0 | 50.0 | 50.0 |
| DEX0455_035.nt.3 | 78519.0 | 50.0 | 50.0 | 40.0 | 40.0 | 58.3 | 58.3 |
| DEX0455_035.nt.3 | 78519.1 | 50.0 | 50.0 | 40.0 | 40.0 | 58.3 | 58.3 |
| DEX0455_035.nt.3 | 78520.0 | 40.9 | 40.9 | 30.0 | 30.0 | 50.0 | 50.0 |
| DEX0455_035.nt.3 | 78520.1 | 45.5 | 45.5 | 40.0 | 40.0 | 50.0 | 50.0 |
| DEX0455_038.nt.1 | 23542.0 | 4.5 | 4.5 | 0.0 | 0.0 | 8.3 | 8.3 |
| DEX0455_038.nt.1 | 23542.1 | 9.1 | 9.1 | 0.0 | 0.0 | 16.7 | 16.7 |
| DEX0455_038.nt.1 | 23543.0 | 0.0 | 0.0 | 0.0 | 0.0 | 0.0 | 0.0 |
| DEX0455_038.nt.1 | 23543.1 | 0.0 | 0.0 | 0.0 | 0.0 | 0.0 | 0.0 |
| DEX0455_038.nt.2 | 23542.0 | 4.5 | 4.5 | 0.0 | 0.0 | 8.3 | 8.3 |
| DEX0455_038.nt.2 | 23542.1 | 9.1 | 9.1 | 0.0 | 0.0 | 16.7 | 16.7 |
| DEX0455_038.nt.2 | 23543.0 | 0.0 | 0.0 | 0.0 | 0.0 | 0.0 | 0.0 |
| DEX0455_038.nt.2 | 23543.1 | 0.0 | 0.0 | 0.0 | 0.0 | 0.0 | 0.0 |
| DEX0455_038.nt.3 | 23542.0 | 4.5 | 4.5 | 0.0 | 0.0 | 8.3 | 8.3 |
| DEX0455_038.nt.3 | 23542.1 | 9.1 | 9.1 | 0.0 | 0.0 | 16.7 | 16.7 |
| DEX0455_038.nt.3 | 23543.0 | 0.0 | 0.0 | 0.0 | 0.0 | 0.0 | 0.0 |
| DEX0455_038.nt.3 | 23543.1 | 0.0 | 0.0 | 0.0 | 0.0 | 0.0 | 0.0 |
| DEX0455_047.nt.1 | 96212.0 | 0.0 | 0.0 | 0.0 | 0.0 | 0.0 | 0.0 |
| DEX0455_047.nt.1 | 96212.1 | 0.0 | 0.0 | 0.0 | 0.0 | 0.0 | 0.0 |
| DEX0455_047.nt.1 | 105764.0 | 4.5 | 5.0 | 10.0 | 12.5 | 0.0 | 0.0 |
| DEX0455_047.nt.1 | 105764.1 | 4.5 | 5.0 | 10.0 | 11.1 | 0.0 | 0.0 |
| DEX0455_047.nt.1 | 105767.0 | 0.0 | 0.0 | 0.0 | 0.0 | 0.0 | 0.0 |
| DEX0455_047.nt.1 | 105767.1 | 0.0 | 0.0 | 0.0 | 0.0 | 0.0 | 0.0 |
| DEX0455_047.nt.1 | 105768.0 | 0.0 | 0.0 | 0.0 | 0.0 | 0.0 | 0.0 |
| DEX0455_047.nt.1 | 105768.1 | 0.0 | 0.0 | 0.0 | 0.0 | 0.0 | 0.0 |
| DEX0455_047.nt.2 | 96212.0 | 0.0 | 0.0 | 0.0 | 0.0 | 0.0 | 0.0 |
| DEX0455_047.nt.2 | 96212.1 | 0.0 | 0.0 | 0.0 | 0.0 | 0.0 | 0.0 |
| DEX0455_047.nt.2 | 105764.0 | 4.5 | 5.0 | 10.0 | 12.5 | 0.0 | 0.0 |
| DEX0455_047.nt.2 | 105764.1 | 4.5 | 5.0 | 10.0 | 11.1 | 0.0 | 0.0 |
| DEX0455_047.nt.2 | 105767.0 | 0.0 | 0.0 | 0.0 | 0.0 | 0.0 | 0.0 |
| DEX0455_047.nt.2 | 105767.1 | 0.0 | 0.0 | 0.0 | 0.0 | 0.0 | 0.0 |
| DEX0455_047.nt.2 | 105768.0 | 0.0 | 0.0 | 0.0 | 0.0 | 0.0 | 0.0 |
| DEX0455_047.nt.2 | 105768.1 | 0.0 | 0.0 | 0.0 | 0.0 | 0.0 | 0.0 |
| DEX0455_048.nt.1 | 1168.0 | 4.5 | 4.5 | 10.0 | 10.0 | 0.0 | 0.0 |

TABLE 10-continued

| DEX ID | Oligo Name | Lng Multi-Cancer ALL % up n = 22 | Lng Multi-Cancer ALL % valid up n = 22 | Lng Multi-Cancer SQ % up n = 10 | Lng Multi-Cancer SQ % valid up n = 10 | Lng Multi-cancer AD % up n = 12 | Lng Multi-Cancer AD % valid up n = 12 |
|---|---|---|---|---|---|---|---|
| DEX0455_048.nt.2 | 1175.0 | 0.0 | 0.0 | 0.0 | 0.0 | 0.0 | 0.0 |
| DEX0455_050.nt.1 | 23378.0 | 0.0 | 0.0 | 0.0 | 0.0 | 0.0 | 0.0 |
| DEX0455_050.nt.1 | 23378.1 | 0.0 | 0.0 | 0.0 | 0.0 | 0.0 | 0.0 |
| DEX0455_050.nt.1 | 23379.0 | 0.0 | 0.0 | 0.0 | 0.0 | 0.0 | 0.0 |
| DEX0455_050.nt.1 | 23379.1 | 0.0 | 0.0 | 0.0 | 0.0 | 0.0 | 0.0 |
| DEX0455_050.nt.1 | 42007.0 | 0.0 | 0.0 | 0.0 | 0.0 | 0.0 | 0.0 |
| DEX0455_050.nt.1 | 42007.1 | 0.0 | 0.0 | 0.0 | 0.0 | 0.0 | 0.0 |
| DEX0455_050.nt.1 | 42007.2 | 0.0 | 0.0 | 0.0 | 0.0 | 0.0 | 0.0 |
| DEX0455_050.nt.1 | 42008.0 | 0.0 | 0.0 | 0.0 | 0.0 | 0.0 | 0.0 |
| DEX0455_050.nt.1 | 42008.1 | 0.0 | 0.0 | 0.0 | 0.0 | 0.0 | 0.0 |
| DEX0455_050.nt.1 | 42008.2 | 0.0 | 0.0 | 0.0 | 0.0 | 0.0 | 0.0 |
| DEX0455_061.nt.1 | 78508.0 | 31.8 | 31.8 | 30.0 | 30.0 | 33.3 | 33.3 |
| DEX0455_061.nt.1 | 78508.1 | 31.8 | 31.8 | 20.0 | 20.0 | 41.7 | 41.7 |
| DEX0455_061.nt.2 | 78508.0 | 31.8 | 31.8 | 30.0 | 30.0 | 33.3 | 33.3 |
| DEX0455_061.nt.2 | 78508.1 | 31.8 | 31.8 | 20.0 | 20.0 | 41.7 | 41.7 |
| DEX0455_061.nt.3 | 78508.0 | 31.8 | 31.8 | 30.0 | 30.0 | 33.3 | 33.3 |
| DEX0455_061.nt.3 | 78508.1 | 31.8 | 31.8 | 20.0 | 20.0 | 41.7 | 41.7 |
| DEX0455_061.nt.4 | 78508.0 | 31.8 | 31.8 | 30.0 | 30.0 | 33.3 | 33.3 |
| DEX0455_061.nt.4 | 78508.1 | 31.8 | 31.8 | 20.0 | 20.0 | 41.7 | 41.7 |
| DEX0455_061.nt.5 | 78508.0 | 31.8 | 31.8 | 30.0 | 30.0 | 33.3 | 33.3 |
| DEX0455_061.nt.5 | 78508.1 | 31.8 | 31.8 | 20.0 | 20.0 | 41.7 | 41.7 |

Prostate Cancer

For prostate cancer three different chip designs were evaluated with overlapping sets of a total of 29 samples, comparing the expression patterns of prostate cancer or benign disease derived total RNA to total RNA isolated from a pool of 35 normal prostate tissues. For the Prostate 1 Array and Prostate 2 Array Chips all 29 samples (17 prostate cancer samples, 12 non-malignant disease samples) were analyzed. For the Multi-Cancer Array Chip a subset of 28 of these samples (16 prostate cancer samples, 12 non-malignant disease samples) were analyzed.

The results for the statistically significant up-regulated genes on the Prostate 1 Array Chip and the Prostate 2 Array Chip are shown in Table 11. The results for the statistically significant up-regulated genes on the Multi-Cancer Array Chip are shown in Table 12. The first two columns of each table contain information about the sequence itself (DEX ID, Oligo Name), the next columns show the results obtained for prostate cancer samples ("CAN") or non-malignant disease samples ("DIS"). '% up' indicates the percentage of all experiments in which up-regulation of at least 2-fold was observed (n=29 for the Prostate 2 Array Chip and the Multi-Cancer Array Chip), '% valid up' indicates the percentage of experiments with valid expression values in which up-regulation of at least 2-fold was observed.

TABLE 11

| DEX ID | Oligo Name | Pro CAN % up n = 17 | Pro CAN % valid up n = 17 | Pro DIS % up n = 12 | Pro DIS % valid up n = 12 |
|---|---|---|---|---|---|
| DEX0455_010.nt.1 | 28129.01 | 0.0 | 0.0 | 0.0 | 0.0 |
| DEX0455_010.nt.1 | 28129.02 | 0.0 | 0.0 | 8.3 | 8.3 |
| DEX0455_010.nt.2 | 28129.01 | 0.0 | 0.0 | 0.0 | 0.0 |
| DEX0455_010.nt.2 | 28129.02 | 0.0 | 0.0 | 8.3 | 8.3 |
| DEX0455_023.nt.1 | 8770.01 | 0.0 | 0.0 | 0.0 | 0.0 |
| DEX0455_023.nt.1 | 8770.02 | 0.0 | 0.0 | 0.0 | 0.0 |
| DEX0455_023.nt.1 | 8770.03 | 0.0 | 0.0 | 0.0 | 0.0 |
| DEX0455_034.nt.1 | 26867.01 | 0.0 | 0.0 | 0.0 | 0.0 |
| DEX0455_034.nt.1 | 26867.02 | 0.0 | 0.0 | 0.0 | 0.0 |
| DEX0455_034.nt.1 | 32554.01 | 0.0 | 0.0 | 0.0 | 0.0 |
| DEX0455_034.nt.1 | 32554.02 | 5.9 | 5.9 | 8.3 | 8.3 |
| DEX0455_034.nt.1 | 32554.03 | 5.9 | 7.1 | 0.0 | 0.0 |
| DEX0455_034.nt.1 | 32558.01 | 0.0 | 0.0 | 0.0 | 0.0 |
| DEX0455_034.nt.1 | 32558.02 | 0.0 | 0.0 | 0.0 | 0.0 |
| DEX0455_034.nt.1 | 32558.03 | 0.0 | 0.0 | 0.0 | 0.0 |
| DEX0455_038.nt.1 | 23492.01 | 0.0 | 0.0 | 0.0 | 0.0 |
| DEX0455_038.nt.1 | 23492.02 | 0.0 | 0.0 | 0.0 | 0.0 |
| DEX0455_038.nt.1 | 23542.01 | 0.0 | 0.0 | 0.0 | 0.0 |
| DEX0455_038.nt.1 | 23542.02 | 0.0 | 0.0 | 0.0 | 0.0 |
| DEX0455_038.nt.1 | 23546.01 | 5.9 | 33.3 | 0.0 | 0.0 |
| DEX0455_038.nt.1 | 23546.02 | 0.0 | 0.0 | 0.0 | 0.0 |
| DEX0455_038.nt.1 | 24418.01 | 0.0 | 0.0 | 0.0 | 0.0 |
| DEX0455_038.nt.1 | 24418.02 | 0.0 | 0.0 | 0.0 | 0.0 |
| DEX0455_038.nt.1 | 24422.01 | 0.0 | 0.0 | 0.0 | 0.0 |
| DEX0455_038.nt.1 | 24422.02 | 0.0 | 0.0 | 0.0 | 0.0 |
| DEX0455_038.nt.1 | 27965.01 | 0.0 | 0.0 | 0.0 | 0.0 |

TABLE 11-continued

| DEX ID | Oligo Name | Pro CAN % up n = 17 | Pro CAN % valid up n = 17 | Pro DIS % up n = 12 | Pro DIS % valid up n = 12 |
|---|---|---|---|---|---|
| DEX0455_038.nt.1 | 27965.02 | 0.0 | 0.0 | 0.0 | 0.0 |
| DEX0455_038.nt.1 | 28535.01 | 0.0 | 0.0 | 0.0 | 0.0 |
| DEX0455_038.nt.1 | 28535.02 | 0.0 | 0.0 | 0.0 | 0.0 |
| DEX0455_038.nt.2 | 23492.01 | 0.0 | 0.0 | 0.0 | 0.0 |
| DEX0455_038.nt.2 | 23492.02 | 0.0 | 0.0 | 0.0 | 0.0 |
| DEX0455_038.nt.2 | 23542.01 | 0.0 | 0.0 | 0.0 | 0.0 |
| DEX0455_038.nt.2 | 23542.02 | 0.0 | 0.0 | 0.0 | 0.0 |
| DEX0455_038.nt.2 | 23684.01 | 0.0 | 0.0 | 0.0 | 0.0 |
| DEX0455_038.nt.2 | 23684.02 | 0.0 | 0.0 | 0.0 | 0.0 |
| DEX0455_038.nt.2 | 24418.01 | 0.0 | 0.0 | 0.0 | 0.0 |
| DEX0455_038.nt.2 | 24418.02 | 0.0 | 0.0 | 0.0 | 0.0 |
| DEX0455_038.nt.2 | 27965.01 | 0.0 | 0.0 | 0.0 | 0.0 |
| DEX0455_038.nt.2 | 27965.02 | 0.0 | 0.0 | 0.0 | 0.0 |
| DEX0455_038.nt.2 | 28535.01 | 0.0 | 0.0 | 0.0 | 0.0 |
| DEX0455_038.nt.2 | 28535.02 | 0.0 | 0.0 | 0.0 | 0.0 |
| DEX0455_038.nt.3 | 23492.01 | 0.0 | 0.0 | 0.0 | 0.0 |
| DEX0455_038.nt.3 | 23492.02 | 0.0 | 0.0 | 0.0 | 0.0 |
| DEX0455_038.nt.3 | 23542.01 | 0.0 | 0.0 | 0.0 | 0.0 |
| DEX0455_038.nt.3 | 23542.02 | 0.0 | 0.0 | 0.0 | 0.0 |
| DEX0455_038.nt.3 | 27965.01 | 0.0 | 0.0 | 0.0 | 0.0 |
| DEX0455_038.nt.3 | 27965.02 | 0.0 | 0.0 | 0.0 | 0.0 |
| DEX0455_038.nt.3 | 28535.01 | 0.0 | 0.0 | 0.0 | 0.0 |
| DEX0455_038.nt.3 | 28535.02 | 0.0 | 0.0 | 0.0 | 0.0 |
| DEX0455_050.nt.1 | 23378.01 | 0.0 | 0.0 | 0.0 | 0.0 |
| DEX0455_050.nt.1 | 23378.02 | 5.9 | 11.1 | 0.0 | 0.0 |
| DEX0455_057.nt.1 | 33332.01 | 0.0 | 0.0 | 0.0 | 0.0 |
| DEX0455_057.nt.1 | 33332.02 | 0.0 | 0.0 | 0.0 | 0.0 |
| DEX0455_057.nt.2 | 33332.01 | 0.0 | 0.0 | 0.0 | 0.0 |
| DEX0455_057.nt.2 | 33332.02 | 0.0 | 0.0 | 0.0 | 0.0 |

TABLE 12

| DEX ID | Oligo Name | Pro Multi-Cancer CAN % up n = 16 | Pro Multi-Cancer CAN % valid up n = 16 | Pro Multi-Cancer DIS % up n = 12 | Pro Multi-Cancer DIS % valid up n = 12 |
|---|---|---|---|---|---|
| DEX0455_002.nt.1 | 79699.1 | 0.0 | 0.0 | 0.0 | 0.0 |
| DEX0455_002.nt.1 | 79700.0 | 0.0 | 0.0 | 0.0 | 0.0 |
| DEX0455_002.nt.1 | 79700.1 | 0.0 | 0.0 | 0.0 | 0.0 |
| DEX0455_004.nt.1 | 96339.0 | 0.0 | 0.0 | 0.0 | 0.0 |
| DEX0455_004.nt.1 | 96339.1 | 0.0 | 0.0 | 0.0 | 0.0 |
| DEX0455_004.nt.1 | 96340.0 | 0.0 | 0.0 | 0.0 | 0.0 |
| DEX0455_004.nt.1 | 96340.1 | 0.0 | 0.0 | 0.0 | 0.0 |
| DEX0455_004.nt.1 | 105991.0 | 0.0 | 0.0 | 0.0 | 0.0 |
| DEX0455_004.nt.1 | 105991.1 | 0.0 | 0.0 | 0.0 | 0.0 |
| DEX0455_004.nt.1 | 105992.0 | 0.0 | 0.0 | 0.0 | 0.0 |
| DEX0455_004.nt.1 | 105992.1 | 0.0 | 0.0 | 0.0 | 0.0 |
| DEX0455_004.nt.1 | 105996.0 | 0.0 | 0.0 | 0.0 | 0.0 |
| DEX0455_004.nt.1 | 105996.1 | 0.0 | 0.0 | 0.0 | 0.0 |
| DEX0455_004.nt.2 | 96339.0 | 0.0 | 0.0 | 0.0 | 0.0 |
| DEX0455_004.nt.2 | 96339.1 | 0.0 | 0.0 | 0.0 | 0.0 |
| DEX0455_004.nt.2 | 96340.0 | 0.0 | 0.0 | 0.0 | 0.0 |
| DEX0455_004.nt.2 | 96340.1 | 0.0 | 0.0 | 0.0 | 0.0 |
| DEX0455_004.nt.2 | 105991.0 | 0.0 | 0.0 | 0.0 | 0.0 |
| DEX0455_004.nt.2 | 105991.1 | 0.0 | 0.0 | 0.0 | 0.0 |
| DEX0455_004.nt.2 | 105992.0 | 0.0 | 0.0 | 0.0 | 0.0 |
| DEX0455_004.nt.2 | 105992.1 | 0.0 | 0.0 | 0.0 | 0.0 |
| DEX0455_004.nt.2 | 105996.0 | 0.0 | 0.0 | 0.0 | 0.0 |
| DEX0455_004.nt.2 | 105996.1 | 0.0 | 0.0 | 0.0 | 0.0 |
| DEX0455_011.nt.1 | 35317.0 | 0.0 | 0.0 | 0.0 | 0.0 |
| DEX0455_011.nt.1 | 35317.1 | 0.0 | 0.0 | 0.0 | 0.0 |
| DEX0455_012.nt.1 | 34334.0 | 17.6 | 18.8 | 0.0 | 0.0 |
| DEX0455_012.nt.1 | 34334.1 | 23.5 | 25.0 | 0.0 | 0.0 |
| DEX0455_012.nt.1 | 34335.0 | 23.5 | 26.7 | 8.3 | 8.3 |
| DEX0455_012.nt.1 | 34335.1 | 17.6 | 18.8 | 0.0 | 0.0 |
| DEX0455_012.nt.2 | 34334.0 | 17.6 | 18.8 | 0.0 | 0.0 |
| DEX0455_012.nt.2 | 34334.1 | 23.5 | 25.0 | 0.0 | 0.0 |
| DEX0455_012.nt.2 | 34335.0 | 23.5 | 26.7 | 8.3 | 8.3 |
| DEX0455_012.nt.2 | 34335.1 | 17.6 | 18.8 | 0.0 | 0.0 |
| DEX0455_017.nt.1 | 36482.0 | 5.9 | 6.7 | 0.0 | 0.0 |
| DEX0455_017.nt.1 | 36482.1 | 5.9 | 6.2 | 0.0 | 0.0 |
| DEX0455_033.nt.1 | 2023.0 | 0.0 | 0.0 | 0.0 | 0.0 |

TABLE 12-continued

| DEX ID | Oligo Name | Pro Multi-Cancer CAN % up n = 16 | Pro Multi Cancer CAN % valid up n = 16 | Pro Multi-Cancer DIS % up n = 12 | Pro Multi-Cancer DIS % valid up n = 12 |
|---|---|---|---|---|---|
| DEX0455_033.nt.1 | 5327.0 | 0.0 | 0.0 | 0.0 | 0.0 |
| DEX0455_033.nt.1 | 5328.0 | 0.0 | 0.0 | 0.0 | 0.0 |
| DEX0455_035.nt.1 | 78519.0 | 0.0 | 0.0 | 0.0 | 0.0 |
| DEX0455_035.nt.1 | 78519.1 | 0.0 | 0.0 | 0.0 | 0.0 |
| DEX0455_035.nt.1 | 78520.0 | 0.0 | 0.0 | 0.0 | 0.0 |
| DEX0455_035.nt.1 | 78520.1 | 0.0 | 0.0 | 0.0 | 0.0 |
| DEX0455_035.nt.2 | 78519.0 | 0.0 | 0.0 | 0.0 | 0.0 |
| DEX0455_035.nt.2 | 78519.1 | 0.0 | 0.0 | 0.0 | 0.0 |
| DEX0455_035.nt.2 | 78520.0 | 0.0 | 0.0 | 0.0 | 0.0 |
| DEX0455_035.nt.2 | 78520.1 | 0.0 | 0.0 | 0.0 | 0.0 |
| DEX0455_035.nt.3 | 78519.0 | 0.0 | 0.0 | 0.0 | 0.0 |
| DEX0455_035.nt.3 | 78519.1 | 0.0 | 0.0 | 0.0 | 0.0 |
| DEX0455_035.nt.3 | 78520.0 | 0.0 | 0.0 | 0.0 | 0.0 |
| DEX0455_035.nt.3 | 78520.1 | 0.0 | 0.0 | 0.0 | 0.0 |
| DEX0455_038.nt.1 | 23542.0 | 0.0 | 0.0 | 0.0 | 0.0 |
| DEX0455_038.nt.1 | 23542.1 | 0.0 | 0.0 | 0.0 | 0.0 |
| DEX0455_038.nt.1 | 23543.0 | 0.0 | 0.0 | 0.0 | 0.0 |
| DEX0455_038.nt.1 | 23543.1 | 0.0 | 0.0 | 0.0 | 0.0 |
| DEX0455_038.nt.2 | 23542.0 | 0.0 | 0.0 | 0.0 | 0.0 |
| DEX0455_038.nt.2 | 23542.1 | 0.0 | 0.0 | 0.0 | 0.0 |
| DEX0455_038.nt.2 | 23543.0 | 0.0 | 0.0 | 0.0 | 0.0 |
| DEX0455_038.nt.2 | 23543.1 | 0.0 | 0.0 | 0.0 | 0.0 |
| DEX0455_038.nt.3 | 23542.0 | 0.0 | 0.0 | 0.0 | 0.0 |
| DEX0455_038.nt.3 | 23542.1 | 0.0 | 0.0 | 0.0 | 0.0 |
| DEX0455_038.nt.3 | 23543.0 | 0.0 | 0.0 | 0.0 | 0.0 |
| DEX0455_038.nt.3 | 23543.1 | 0.0 | 0.0 | 0.0 | 0.0 |
| DEX0455_047.nt.1 | 96212.0 | 0.0 | 0.0 | 0.0 | 0.0 |
| DEX0455_047.nt.1 | 96212.1 | 0.0 | 0.0 | 0.0 | 0.0 |
| DEX0455_047.nt.1 | 105764.0 | 0.0 | 0.0 | 0.0 | 0.0 |
| DEX0455_047.nt.1 | 105764.1 | 0.0 | 0.0 | 0.0 | 0.0 |
| DEX0455_047.nt.1 | 105767.0 | 0.0 | 0.0 | 0.0 | 0.0 |
| DEX0455_047.nt.1 | 105767.1 | 0.0 | 0.0 | 0.0 | 0.0 |
| DEX0455_047.nt.1 | 105768.0 | 0.0 | 0.0 | 0.0 | 0.0 |
| DEX0455_047.nt.1 | 105768.1 | 0.0 | 0.0 | 0.0 | 0.0 |
| DEX0455_047.nt.2 | 96212.0 | 0.0 | 0.0 | 0.0 | 0.0 |
| DEX0455_047.nt.2 | 96212.1 | 0.0 | 0.0 | 0.0 | 0.0 |
| DEX0455_047.nt.2 | 105764.0 | 0.0 | 0.0 | 0.0 | 0.0 |
| DEX0455_047.nt.2 | 105764.1 | 0.0 | 0.0 | 0.0 | 0.0 |
| DEX0455_047.nt.2 | 105767.0 | 0.0 | 0.0 | 0.0 | 0.0 |
| DEX0455_047.nt.2 | 105767.1 | 0.0 | 0.0 | 0.0 | 0.0 |
| DEX0455_047.nt.2 | 105768.0 | 0.0 | 0.0 | 0.0 | 0.0 |
| DEX0455_047.nt.2 | 105768.1 | 0.0 | 0.0 | 0.0 | 0.0 |
| DEX0455_048.nt.1 | 1168.0 | 0.0 | 0.0 | 8.3 | 8.3 |
| DEX0455_048.nt.2 | 1175.0 | 0.0 | 0.0 | 0.0 | 0.0 |
| DEX0455_050.nt.1 | 23378.0 | 0.0 | 0.0 | 0.0 | 0.0 |
| DEX0455_050.nt.1 | 23378.1 | 0.0 | 0.0 | 0.0 | 0.0 |
| DEX0455_050.nt.1 | 23379.0 | 0.0 | 0.0 | 0.0 | 0.0 |
| DEX0455_050.nt.1 | 23379.1 | 0.0 | 0.0 | 0.0 | 0.0 |
| DEX0455_050.nt.1 | 42007.0 | 0.0 | 0.0 | 0.0 | 0.0 |
| DEX0455_050.nt.1 | 42007.1 | 0.0 | 0.0 | 0.0 | 0.0 |
| DEX0455_050.nt.1 | 42007.2 | 0.0 | 0.0 | 0.0 | 0.0 |
| DEX0455_050.nt.1 | 42008.0 | 0.0 | 0.0 | 0.0 | 0.0 |
| DEX0455_050.nt.1 | 42008.1 | 0.0 | 0.0 | 0.0 | 0.0 |
| DEX0455_050.nt.1 | 42008.2 | 0.0 | 0.0 | 0.0 | 0.0 |
| DEX0455_061.nt.1 | 78508.0 | 0.0 | 0.0 | 0.0 | 0.0 |
| DEX0455_061.nt.1 | 78508.1 | 0.0 | 0.0 | 0.0 | 0.0 |
| DEX0455_061.nt.2 | 78508.0 | 0.0 | 0.0 | 0.0 | 0.0 |
| DEX0455_061.nt.2 | 78508.1 | 0.0 | 0.0 | 0.0 | 0.0 |
| DEX0455_061.nt.3 | 78508.0 | 0.0 | 0.0 | 0.0 | 0.0 |
| DEX0455_061.nt.3 | 78508.1 | 0.0 | 0.0 | 0.0 | 0.0 |
| DEX0455_061.nt.4 | 78508.0 | 0.0 | 0.0 | 0.0 | 0.0 |
| DEX0455_061.nt.4 | 78508.1 | 0.0 | 0.0 | 0.0 | 0.0 |
| DEX0455_061.nt.5 | 78508.0 | 0.0 | 0.0 | 0.0 | 0.0 |
| DEX0455_061.nt.5 | 78508.1 | 0.0 | 0.0 | 0.0 | 0.0 |

SEQ ID NO: 1-128 was up-regulated on various tissue microarrays. Accordingly, nucleotide SEQ ID NO: 1-128 or the encoded protein SEQ ID NO: 129-295 may be used as a cancer therapeutic and/or diagnostic target for the tissues in which expression is shown.

The following table lists the location (Oligo Location) where the microarray oligos (Oligo ID) map on the transcripts (DEX ID) of the present invention. Each Oligo ID may have been printed multiple times on a single chip as replicates. The Oligo Name is an exemplary replicate (e.g. 1000.01) for the Oligo ID (e.g. 1000), and data from other replicates (e.g. 1000.02, 1000.03) may be reported. Additionally, the Array (Chip Name) that each oligo and oligo replicates were printed on is included.

| DEX NT ID | Oligo ID | Oligo Name | Chip Name | Oligo Location |
|---|---|---|---|---|
| DEX0455_001.nt.1 | 34930 | 34930.01 | Ovarian array | 4736-4795 |
| DEX0455_002.nt.1 | 21577 | 21577.02 | Ovarian array | 198-257 |
| DEX0455_002.nt.1 | 79699 | 79699.0 | Multi-Cancer array | 1430-1489 |
| DEX0455_002.nt.1 | 21553 | 21553.01 | Ovarian array | 513-572 |
| DEX0455_002.nt.1 | 79700 | 79700.0 | Multi-Cancer array | 1429-1488 |
| DEX0455_003.nt.1 | 17466 | 17466.02 | Ovarian array | 1075-1134 |
| DEX0455_004.nt.1 | 96340 | 96340.0 | Multi-Cancer array | 6807-6866 |
| DEX0455_004.nt.1 | 96339 | 96339.0 | Multi-Cancer array | 6906-6965 |
| DEX0455_004.nt.1 | 105991 | 105991.0 | Multi-Cancer array | 6906-6965 |
| DEX0455_004.nt.1 | 105992 | 105992.0 | Multi-Cancer array | 6807-6866 |
| DEX0455_004.nt.1 | 105996 | 105996.0 | Multi-Cancer array | 8462-8521 |
| DEX0455_004.nt.2 | 96340 | 96340.0 | Multi-Cancer array | 5651-5710 |
| DEX0455_004.nt.2 | 105991 | 105991.0 | Multi-Cancer array | 5750-5809 |
| DEX0455_004.nt.2 | 105992 | 105992.0 | Multi-Cancer array | 5651-5710 |
| DEX0455_004.nt.2 | 105996 | 105996.0 | Multi-Cancer array | 7306-7365 |
| DEX0455_004.nt.2 | 96339 | 96339.0 | Multi-Cancer array | 5750-5809 |
| DEX0455_005.nt.1 | 24874 | 24874.01 | Ovarian array | 475-534 |
| DEX0455_005.nt.1 | 20619 | 20619.02 | Ovarian array | 472-531 |
| DEX0455_005.nt.2 | 24874 | 24874.01 | Ovarian array | 475-534 |
| DEX0455_007.nt.1 | 30109 | 30109.01 | Ovarian array | 982-1041 |
| DEX0455_008.nt.1 | 22387 | 22387.01 | Ovarian array | 1666-1725 |
| DEX0455_008.nt.1 | 18508 | 18508.02 | Ovarian array | 1193-1252 |
| DEX0455_009.nt.1 | 9720 | 9720.02 | Ovarian array | 1745-1804 |
| DEX0455_010.nt.1 | 2721 | 2721.0 | Lung array | 501-560 |
| DEX0455_010.nt.1 | 37415 | 37415.0 | Colon array | 1040-1099 |
| DEX0455_010.nt.1 | 32151 | 32151.0 | Breast array | 748-807 |
| DEX0455_010.nt.1 | 2720 | 2720.0 | Lung array | 542-601 |
| DEX0455_010.nt.1 | 21675 | 21675.02 | Ovarian array | 965-1024 |
| DEX0455_010.nt.1 | 20627 | 20627.02 | Ovarian array | 250-309 |
| DEX0455_010.nt.1 | 28129 | 28129.02 | Prostate1 array | 964-1023 |
| DEX0455_010.nt.1 | 791 | 791.0 | Lung array | 1045-1104 |
| DEX0455_010.nt.2 | 2720 | 2720.0 | Lung array | 379-438 |
| DEX0455_010.nt.2 | 32151 | 32151.0 | Breast array | 585-644 |
| DEX0455_010.nt.2 | 28129 | 28129.02 | Prostate1 array | 801-860 |
| DEX0455_010.nt.2 | 37415 | 37415.0 | Colon array | 877-936 |
| DEX0455_010.nt.2 | 21675 | 21675.02 | Ovarian array | 802-861 |
| DEX0455_010.nt.2 | 791 | 791.0 | Lung array | 882-941 |
| DEX0455_010.nt.2 | 2721 | 2721.0 | Lung array | 338-397 |
| DEX0455_011.nt.1 | 35317 | 35317.0 | Colon array | 398-457 |
| DEX0455_012.nt.1 | 34368 | 34368.0 | Colon array | 2484-2543 |
| DEX0455_012.nt.1 | 34369 | 34369.0 | Colon array | 2441-2500 |
| DEX0455_012.nt.1 | 34334 | 34334.0 | Colon array | 3108-3167 |
| DEX0455_012.nt.1 | 34343 | 34343.0 | Colon array | 472-531 |
| DEX0455_012.nt.1 | 34335 | 34335.0 | Colon array | 3022-3081 |
| DEX0455_012.nt.2 | 34334 | 34334.0 | Colon array | 2527-2586 |
| DEX0455_012.nt.2 | 34343 | 34343.0 | Colon array | 472-531 |
| DEX0455_012.nt.2 | 34369 | 34369.0 | Colon array | 1860-1919 |
| DEX0455_012.nt.2 | 34335 | 34335.0 | Colon array | 2441-2500 |
| DEX0455_012.nt.2 | 34368 | 34368.0 | Colon array | 1903-1962 |
| DEX0455_013.nt.1 | 9838 | 9838.02 | Ovarian array | 1304-1363 |
| DEX0455_014.nt.1 | 10624 | 10624.02 | Ovarian array | 1832-1891 |
| DEX0455_014.nt.1 | 14604 | 14604.01 | Ovarian array | 925-984 |
| DEX0455_015.nt.1 | 19518 | 19518.01 | Ovarian array | 277-336 |
| DEX0455_016.nt.1 | 23734 | 23734.02 | Ovarian array | 531-590 |
| DEX0455_017.nt.1 | 28221 | 28221.0 | Breast array | 679-738 |
| DEX0455_017.nt.1 | 21032 | 21032.0 | Colon array | 314-373 |
| DEX0455_017.nt.1 | 36482 | 36482.0 | Multi-Cancer array | 314-373 |
| DEX0455_018.nt.1 | 21575 | 21575.01 | Ovarian array | 1516-1575 |
| DEX0455_018.nt.1 | 21571 | 21571.02 | Ovarian array | 623-682 |
| DEX0455_018.nt.1 | 21609 | 21609.02 | Ovarian array | 933-992 |
| DEX0455_018.nt.2 | 21575 | 21575.01 | Ovarian array | 2287-2346 |
| DEX0455_019.nt.1 | 20669 | 20669.01 | Ovarian array | 615-674 |
| DEX0455_021.nt.1 | 23780 | 23780.01 | Ovarian array | 517-576 |
| DEX0455_021.nt.1 | 21469 | 21469.02 | Ovarian array | 430-489 |
| DEX0455_021.nt.1 | 21433 | 21433.01 | Ovarian array | 518-577 |
| DEX0455_021.nt.1 | 21475 | 21475.01 | Ovarian array | 517-576 |
| DEX0455_021.nt.2 | 21469 | 21469.02 | Ovarian array | 1528-1587 |
| DEX0455_021.nt.2 | 21475 | 21475.01 | Ovarian array | 1615-1674 |
| DEX0455_021.nt.2 | 21433 | 21433.01 | Ovarian array | 1616-1675 |
| DEX0455_021.nt.2 | 23780 | 23780.01 | Ovarian array | 1615-1674 |
| DEX0455_021.nt.3 | 21433 | 21433.01 | Ovarian array | 1859-1918 |
| DEX0455_021.nt.3 | 21475 | 21475.01 | Ovarian array | 1858-1917 |
| DEX0455_021.nt.3 | 21469 | 21469.02 | Ovarian array | 1771-1830 |
| DEX0455_021.nt.3 | 23780 | 23780.01 | Ovarian array | 1858-1917 |
| DEX0455_021.nt.4 | 21469 | 21469.02 | Ovarian array | 1914-1973 |
| DEX0455_021.nt.4 | 21475 | 21475.01 | Ovarian array | 2001-2060 |
| DEX0455_021.nt.4 | 21433 | 21433.01 | Ovarian array | 2002-2061 |
| DEX0455_022.nt.1 | 9920 | 9920.02 | Ovarian array | 1022-1081 |

-continued

| DEX NT ID | Oligo ID | Oligo Name | Chip Name | Oligo Location |
|---|---|---|---|---|
| DEX0455_022.nt.1 | 20311 | 20311.01 | Ovarian array | 718-777 |
| DEX0455_022.nt.1 | 20299 | 20299.01 | Ovarian array | 529-588 |
| DEX0455_022.nt.1 | 23280 | 23280.0 | Breast array | 427-486 |
| DEX0455_022.nt.1 | 20317 | 20317.02 | Ovarian array | 718-777 |
| DEX0455_022.nt.2 | 9920 | 9920.02 | Ovarian array | 1016-1075 |
| DEX0455_022.nt.2 | 20311 | 20311.01 | Ovarian array | 712-771 |
| DEX0455_022.nt.2 | 20317 | 20317.02 | Ovarian array | 712-771 |
| DEX0455_022.nt.2 | 20299 | 20299.01 | Ovarian array | 552-611 |
| DEX0455_022.nt.3 | 9920 | 9920.02 | Ovarian array | 613-672 |
| DEX0455_022.nt.3 | 20317 | 20317.02 | Ovarian array | 309-368 |
| DEX0455_022.nt.3 | 20311 | 20311.01 | Ovarian array | 309-368 |
| DEX0455_023.nt.1 | 16374 | 16374.02 | Ovarian array | 2119-2178 |
| DEX0455_023.nt.1 | 8770 | 8770.03 | Prostate2 array | 1897-1956 |
| DEX0455_023.nt.1 | 16378 | 16378.01 | Ovarian array | 937-996 |
| DEX0455_023.nt.1 | 16187 | 16187.01 | Ovarian array | 666-725 |
| DEX0455_024.nt.1 | 21507 | 21507.01 | Ovarian array | 2357-2416 |
| DEX0455_024.nt.1 | 21487 | 21487.01 | Ovarian array | 796-855 |
| DEX0455_024.nt.1 | 12149 | 12149.01 | Ovarian array | 2439-2498 |
| DEX0455_024.nt.1 | 21547 | 21547.02 | Ovarian array | 1555-1614 |
| DEX0455_024.nt.1 | 17957 | 17957.0 | Colon array | 2002-2061 |
| DEX0455_024.nt.2 | 21507 | 21507.01 | Ovarian array | 1790-1849 |
| DEX0455_024.nt.2 | 12149 | 12149.01 | Ovarian array | 1872-1931 |
| DEX0455_024.nt.2 | 21547 | 21547.02 | Ovarian array | 988-1047 |
| DEX0455_024.nt.2 | 17957 | 17957.0 | Colon array | 1435-1494 |
| DEX0455_025.nt.1 | 12167 | 12167.01 | Ovarian array | 475-534 |
| DEX0455_025.nt.1 | 16964 | 16964.02 | Ovarian array | 3509-3568 |
| DEX0455_025.nt.1 | 16956 | 16956.02 | Ovarian array | 3533-3592 |
| DEX0455_025.nt.1 | 16958 | 16958.01 | Ovarian array | 808-867 |
| DEX0455_025.nt.1 | 19010 | 19010.01 | Ovarian array | 1260-1319 |
| DEX0455_025.nt.2 | 12167 | 12167.01 | Ovarian array | 475-534 |
| DEX0455_025.nt.2 | 16964 | 16964.02 | Ovarian array | 2465-2524 |
| DEX0455_025.nt.2 | 16956 | 16956.02 | Ovarian array | 2489-2548 |
| DEX0455_025.nt.2 | 16958 | 16958.01 | Ovarian array | 808-867 |
| DEX0455_025.nt.2 | 19010 | 19010.01 | Ovarian array | 1260-1319 |
| DEX0455_025.nt.3 | 12167 | 12167.01 | Ovarian array | 475-534 |
| DEX0455_025.nt.3 | 19010 | 19010.01 | Ovarian array | 1260-1319 |
| DEX0455_025.nt.3 | 16958 | 16958.01 | Ovarian array | 808-867 |
| DEX0455_025.nt.4 | 19010 | 19010.01 | Ovarian array | 1260-1319 |
| DEX0455_025.nt.4 | 16956 | 16956.02 | Ovarian array | 2167-2226 |
| DEX0455_025.nt.4 | 16964 | 16964.02 | Ovarian array | 2143-2202 |
| DEX0455_025.nt.4 | 12167 | 12167.01 | Ovarian array | 475-534 |
| DEX0455_027.nt.1 | 21549 | 21549.01 | Ovarian array | 1483-1542 |
| DEX0455_028.nt.1 | 41120 | 41120.0 | Colon array | 477-536 |
| DEX0455_028.nt.1 | 30821 | 30821.0 | Colon array | 673-732 |
| DEX0455_029.nt.1 | 41151 | 41151.0 | Colon array | 2429-2488 |
| DEX0455_029.nt.1 | 22113 | 22113.01 | Ovarian array | 3222-3281 |
| DEX0455_029.nt.1 | 30869 | 30869.0 | Colon array | 5572-5631 |
| DEX0455_029.nt.1 | 41120 | 41120.0 | Colon array | 1984-2043 |
| DEX0455_029.nt.1 | 23386 | 23386.01 | Ovarian array | 2429-2488 |
| DEX0455_029.nt.1 | 30820 | 30820.0 | Colon array | 2388-2447 |
| DEX0455_029.nt.1 | 41117 | 41117.0 | Colon array | 2296-2355 |
| DEX0455_029.nt.1 | 30821 | 30821.0 | Colon array | 2348-2407 |
| DEX0455_029.nt.1 | 23400 | 23400.02 | Ovarian array | 2296-2355 |
| DEX0455_029.nt.1 | 41152 | 41152.0 | Colon array | 2372-2431 |
| DEX0455_029.nt.1 | 17430 | 17430.02 | Ovarian array | 2388-2447 |
| DEX0455_029.nt.1 | 30824 | 30824.0 | Colon array | 5798-5857 |
| DEX0455_029.nt.1 | 17448 | 17448.01 | Ovarian array | 5798-5857 |
| DEX0455_029.nt.2 | 41120 | 41120.0 | Colon array | 2412-2471 |
| DEX0455_029.nt.2 | 17430 | 17430.02 | Ovarian array | 2816-2875 |
| DEX0455_029.nt.2 | 23386 | 23386.01 | Ovarian array | 2857-2916 |
| DEX0455_029.nt.2 | 30824 | 30824.0 | Colon array | 5101-5160 |
| DEX0455_029.nt.2 | 17424 | 17424.01 | Ovarian array | 4880-4939 |
| DEX0455_029.nt.2 | 30922 | 30922.0 | Colon array | 4880-4939 |
| DEX0455_029.nt.2 | 23400 | 23400.02 | Ovarian array | 2724-2783 |
| DEX0455_029.nt.2 | 41152 | 41152.0 | Colon array | 2800-2859 |
| DEX0455_029.nt.2 | 30820 | 30820.0 | Colon array | 2816-2875 |
| DEX0455_029.nt.2 | 22113 | 22113.01 | Ovarian array | 3650-3709 |
| DEX0455_029.nt.2 | 41117 | 41117.0 | Colon array | 2724-2783 |
| DEX0455_029.nt.2 | 41151 | 41151.0 | Colon array | 2857-2916 |
| DEX0455_029.nt.2 | 30821 | 30821.0 | Colon array | 2776-2835 |
| DEX0455_029.nt.2 | 17448 | 17448.01 | Ovarian array | 5101-5160 |
| DEX0455_030.nt.1 | 17204 | 17204.02 | Ovarian array | 1225-1284 |
| DEX0455_030.nt.1 | 17262 | 17262.02 | Ovarian array | 1011-1070 |
| DEX0455_030.nt.1 | 17278 | 17278.02 | Ovarian array | 991-1050 |
| DEX0455_030.nt.1 | 11613 | 11613.01 | Ovarian array | 1011-1070 |
| DEX0455_030.nt.2 | 17274 | 17274.02 | Ovarian array | 696-755 |
| DEX0455_030.nt.2 | 17204 | 17204.02 | Ovarian array | 984-1043 |
| DEX0455_030.nt.2 | 17278 | 17278.02 | Ovarian array | 713-772 |

-continued

| DEX NT ID | Oligo ID | Oligo Name | Chip Name | Oligo Location |
|---|---|---|---|---|
| DEX0455_030.nt.2 | 17262 | 17262.02 | Ovarian array | 733-792 |
| DEX0455_031.nt.1 | 20773 | 20773.02 | Ovarian array | 2724-2783 |
| DEX0455_032.nt.1 | 2688 | 2688.0 | Lung array | 952-1011 |
| DEX0455_032.nt.1 | 11585 | 11585.01 | Ovarian array | 1342-1401 |
| DEX0455_032.nt.1 | 2689 | 2689.0 | Lung array | 910-969 |
| DEX0455_032.nt.1 | 18556 | 18556.02 | Ovarian array | 952-1011 |
| DEX0455_032.nt.1 | 5313 | 5313.0 | Lung array | 1342-1401 |
| DEX0455_033.nt.1 | 5328 | 5328.0 | Multi-Cancer array | 402-461 |
| DEX0455_033.nt.1 | 2006 | 2006.0 | Lung array | 402-461 |
| DEX0455_033.nt.1 | 2022 | 2022.0 | Lung array | 482-541 |
| DEX0455_033.nt.1 | 2032 | 2032.0 | Lung array | 290-349 |
| DEX0455_033.nt.1 | 2007 | 2007.0 | Lung array | 361-420 |
| DEX0455_033.nt.1 | 5327 | 5327.0 | Multi-Cancer array | 442-501 |
| DEX0455_033.nt.1 | 2023 | 2023.0 | Multi-Cancer array | 442-501 |
| DEX0455_034.nt.1 | 10722 | 10722.02 | Ovarian array | 2454-2513 |
| DEX0455_034.nt.1 | 32554 | 32554.02 | Prostate2 array | 1815-1874 |
| DEX0455_034.nt.1 | 21421 | 21421.02 | Ovarian array | 1815-1874 |
| DEX0455_034.nt.1 | 32558 | 32558.01 | Prostate2 array | 1053-1112 |
| DEX0455_034.nt.1 | 16423 | 16423.0 | Colon array | 885-944 |
| DEX0455_034.nt.1 | 21401 | 21401.02 | Ovarian array | 1053-1112 |
| DEX0455_034.nt.1 | 26867 | 26867.01 | Prostate1 array | 2454-2513 |
| DEX0455_035.nt.1 | 78519 | 78519.0 | Multi-Cancer array | 923-982 |
| DEX0455_035.nt.1 | 78520 | 78520.0 | Multi-Cancer array | 857-916 |
| DEX0455_035.nt.1 | 103385 | 103385.01 | Ovarian array | 926-985 |
| DEX0455_035.nt.2 | 78519 | 78519.0 | Multi-Cancer array | 1152-1211 |
| DEX0455_035.nt.2 | 103385 | 103385.01 | Ovarian array | 1155-1214 |
| DEX0455_035.nt.2 | 78520 | 78520.0 | Multi-Cancer array | 1086-1145 |
| DEX0455_035.nt.3 | 103385 | 103385.01 | Ovarian array | 1034-1093 |
| DEX0455_035.nt.3 | 78519 | 78519.0 | Multi-Cancer array | 1031-1090 |
| DEX0455_035.nt.3 | 78520 | 78520.0 | Multi-Cancer array | 965-1024 |
| DEX0455_035.nt.3 | 21144 | 21144.0 | Breast array | 126-185 |
| DEX0455_035.nt.3 | 21143 | 21143.0 | Breast array | 212-271 |
| DEX0455_036.nt.1 | 92327 | 92327.01 | Ovarian array | 177-236 |
| DEX0455_037.nt.1 | 17490 | 17490.01 | Ovarian array | 894-953 |
| DEX0455_037.nt.1 | 11575 | 11575.01 | Ovarian array | 892-951 |
| DEX0455_037.nt.1 | 17486 | 17486.01 | Ovarian array | 887-946 |
| DEX0455_037.nt.2 | 17490 | 17490.01 | Ovarian array | 1459-1518 |
| DEX0455_037.nt.2 | 11575 | 11575.01 | Ovarian array | 1457-1516 |
| DEX0455_037.nt.3 | 17490 | 17490.01 | Ovarian array | 2399-2458 |
| DEX0455_037.nt.3 | 11575 | 11575.01 | Ovarian array | 2397-2456 |
| DEX0455_037.nt.3 | 17486 | 17486.01 | Ovarian array | 2392-2451 |
| DEX0455_037.nt.4 | 17490 | 17490.01 | Ovarian array | 515-574 |
| DEX0455_037.nt.4 | 17486 | 17486.01 | Ovarian array | 508-567 |
| DEX0455_037.nt.4 | 11575 | 11575.01 | Ovarian array | 513-572 |
| DEX0455_037.nt.5 | 17486 | 17486.01 | Ovarian array | 571-630 |
| DEX0455_037.nt.5 | 17490 | 17490.01 | Ovarian array | 578-637 |
| DEX0455_037.nt.5 | 11575 | 11575.01 | Ovarian array | 576-635 |
| DEX0455_038.nt.1 | 23543 | 23543.0 | Multi-Cancer array | 5011-5070 |
| DEX0455_038.nt.1 | 23492 | 23492.02 | Prostate1 array | 5433-5492 |
| DEX0455_038.nt.1 | 23546 | 23546.01 | Prostate1 array | 3874-3933 |
| DEX0455_038.nt.1 | 24422 | 24422.01 | Prostate1 array | 3874-3933 |
| DEX0455_038.nt.1 | 23542 | 23542.0 | Multi-Cancer array | 5118-5177 |
| DEX0455_038.nt.1 | 24418 | 24418.01 | Prostate1 array | 2859-2918 |
| DEX0455_038.nt.1 | 27965 | 27965.01 | Prostate1 array | 1956-2015 |
| DEX0455_038.nt.1 | 28535 | 28535.01 | Prostate1 array | 5154-5213 |
| DEX0455_038.nt.2 | 27965 | 27965.01 | Prostate1 array | 1956-2015 |
| DEX0455_038.nt.2 | 23543 | 23543.0 | Multi-Cancer array | 4443-4502 |
| DEX0455_038.nt.2 | 28535 | 28535.01 | Prostate1 array | 4586-4645 |
| DEX0455_038.nt.2 | 23492 | 23492.02 | Prostate1 array | 4865-4924 |
| DEX0455_038.nt.2 | 24418 | 24418.01 | Prostate1 array | 2859-2918 |
| DEX0455_038.nt.2 | 23542 | 23542.0 | Multi-Cancer array | 4550-4609 |
| DEX0455_038.nt.2 | 23684 | 23684.02 | Prostate1 array | 3719-3778 |
| DEX0455_038.nt.3 | 23543 | 23543.0 | Multi-Cancer array | 2528-2587 |
| DEX0455_038.nt.3 | 23492 | 23492.02 | Prostate1 array | 2950-3009 |
| DEX0455_038.nt.3 | 23542 | 23542.0 | Multi-Cancer array | 2635-2694 |
| DEX0455_038.nt.3 | 27965 | 27965.01 | Prostate1 array | 1693-1752 |
| DEX0455_038.nt.3 | 28535 | 28535.01 | Prostate1 array | 2671-2730 |
| DEX0455_039.nt.1 | 21505 | 21505.02 | Ovarian array | 355-414 |
| DEX0455_039.nt.2 | 11527 | 11527.0 | Ovarian array | 467-526 |
| DEX0455_040.nt.1 | 21489 | 21489.02 | Ovarian array | 281-340 |
| DEX0455_040.nt.1 | 21501 | 21501.02 | Ovarian array | 772-831 |
| DEX0455_040.nt.1 | 21511 | 21511.01 | Ovarian array | 586-645 |
| DEX0455_040.nt.2 | 21489 | 21489.02 | Ovarian array | 698-757 |
| DEX0455_040.nt.2 | 21511 | 21511.01 | Ovarian array | 1003-1062 |
| DEX0455_040.nt.2 | 21501 | 21501.02 | Ovarian array | 1189-1248 |
| DEX0455_041.nt.1 | 16980 | 16980.01 | Ovarian array | 125-184 |
| DEX0455_041.nt.1 | 16998 | 16998.0 | Breast array | 125-184 |
| DEX0455_041.nt.1 | 12155 | 12155.01 | Ovarian array | 309-368 |

| DEX NT ID | Oligo ID | Oligo Name | Chip Name | Oligo Location |
|---|---|---|---|---|
| DEX0455_042.nt.1 | 889 | 889.0 | Lung array | 346-405 |
| DEX0455_042.nt.1 | 18214 | 18214.02 | Ovarian array | 346-405 |
| DEX0455_043.nt.1 | 14656 | 14656.02 | Ovarian array | 463-522 |
| DEX0455_045.nt.1 | 36013 | 36013.01 | Ovarian array | 382-441 |
| DEX0455_046.nt.1 | 17314 | 17314.01 | Ovarian array | 614-673 |
| DEX0455_046.nt.1 | 19072 | 19072.0 | Breast array | 614-673 |
| DEX0455_047.nt.1 | 105768 | 105768.0 | Multi-Cancer array | 3274-3333 |
| DEX0455_047.nt.1 | 96212 | 96212.0 | Multi-Cancer array | 2703-2762 |
| DEX0455_047.nt.1 | 105767 | 105767.0 | Multi-Cancer array | 3314-3373 |
| DEX0455_047.nt.1 | 105764 | 105764.0 | Multi-Cancer array | 2703-2762 |
| DEX0455_047.nt.2 | 105768 | 105768.0 | Multi-Cancer array | 1478-1537 |
| DEX0455_047.nt.2 | 105767 | 105767.0 | Multi-Cancer array | 1518-1577 |
| DEX0455_047.nt.2 | 96212 | 96212.0 | Multi-Cancer array | 907-966 |
| DEX0455_048.nt.1 | 1169 | 1169.0 | Lung array | 175-234 |
| DEX0455_048.nt.1 | 1011 | 1011.0 | Lung array | 202-261 |
| DEX0455_048.nt.1 | 1009 | 1009.0 | Lung array | 192-251 |
| DEX0455_048.nt.1 | 1010 | 1010.0 | Lung array | 242-301 |
| DEX0455_048.nt.1 | 1168 | 1168.0 | Multi-Cancer array | 180-239 |
| DEX0455_048.nt.2 | 1169 | 1169.0 | Lung array | 386-445 |
| DEX0455_048.nt.2 | 1011 | 1011.0 | Lung array | 413-472 |
| DEX0455_048.nt.2 | 1009 | 1009.0 | Lung array | 403-462 |
| DEX0455_048.nt.2 | 1175 | 1175.0 | Multi-Cancer array | 254-313 |
| DEX0455_048.nt.2 | 1168 | 1168.0 | Multi-Cancer array | 391-450 |
| DEX0455_048.nt.2 | 1174 | 1174.0 | Lung array | 259-318 |
| DEX0455_048.nt.2 | 1010 | 1010.0 | Lung array | 453-512 |
| DEX0455_049.nt.1 | 11511 | 11511.02 | Ovarian array | 2111-2170 |
| DEX0455_049.nt.1 | 36902 | 36902.0 | Colon array | 928-987 |
| DEX0455_049.nt.2 | 36901 | 36901.0 | Colon array | 621-680 |
| DEX0455_049.nt.2 | 11511 | 11511.02 | Ovarian array | 1528-1587 |
| DEX0455_049.nt.2 | 36902 | 36902.0 | Colon array | 582-641 |
| DEX0455_049.nt.3 | 36901 | 36901.0 | Colon array | 967-1026 |
| DEX0455_049.nt.4 | 11511 | 11511.02 | Ovarian array | 2102-2161 |
| DEX0455_049.nt.4 | 36902 | 36902.0 | Colon array | 1156-1215 |
| DEX0455_049.nt.4 | 36901 | 36901.0 | Colon array | 1195-1254 |
| DEX0455_049.nt.5 | 36902 | 36902.0 | Colon array | 299-358 |
| DEX0455_049.nt.5 | 11511 | 11511.02 | Ovarian array | 1245-1304 |
| DEX0455_050.nt.1 | 29736 | 29736.0 | Breast array | 171-230 |
| DEX0455_050.nt.1 | 7815 | 7815.0 | Lung array | 385-444 |
| DEX0455_050.nt.1 | 23378 | 23378.0 | Breast array | 684-743 |
| DEX0455_050.nt.1 | 42008 | 42008.0 | Multi-Cancer array | 329-388 |
| DEX0455_050.nt.1 | 42007 | 42007.0 | Multi-Cancer array | 329-388 |
| DEX0455_050.nt.1 | 22136 | 22136.0 | Breast array | 636-695 |
| DEX0455_050.nt.1 | 23379 | 23379.0 | Breast array | 385-444 |
| DEX0455_052.nt.1 | 91971 | 91971.01 | Ovarian array | 1686-1745 |
| DEX0455_054.nt.1 | 19799 | 19799.0 | Breast array | 1918-1977 |
| DEX0455_055.nt.1 | 20541 | 20541.01 | Ovarian array | 1705-1764 |
| DEX0455_055.nt.1 | 12731 | 12731.0 | Breast array | 1601-1660 |
| DEX0455_055.nt.1 | 12732 | 12732.0 | Breast array | 1395-1454 |
| DEX0455_055.nt.1 | 11273 | 11273.02 | Ovarian array | 1815-1874 |
| DEX0455_055.nt.2 | 20541 | 20541.01 | Ovarian array | 1403-1462 |
| DEX0455_055.nt.2 | 12731 | 12731.0 | Breast array | 1299-1358 |
| DEX0455_055.nt.2 | 12732 | 12732.0 | Breast array | 1136-1195 |
| DEX0455_055.nt.2 | 11273 | 11273.02 | Ovarian array | 1513-1572 |
| DEX0455_055.nt.3 | 12732 | 12732.0 | Breast array | 568-627 |
| DEX0455_055.nt.3 | 12731 | 12731.0 | Breast array | 731-790 |
| DEX0455_055.nt.3 | 20541 | 20541.01 | Ovarian array | 835-894 |
| DEX0455_056.nt.1 | 23444 | 23444.01 | Ovarian array | 2588-2647 |
| DEX0455_056.nt.1 | 3161 | 3161.0 | Lung array | 2547-2606 |
| DEX0455_056.nt.1 | 3164 | 3164.0 | Lung array | 3317-3376 |
| DEX0455_056.nt.1 | 3160 | 3160.0 | Lung array | 2588-2647 |
| DEX0455_056.nt.1 | 3165 | 3165.0 | Lung array | 3277-3336 |
| DEX0455_056.nt.1 | 1583 | 1583.0 | Lung array | 3277-3336 |
| DEX0455_056.nt.1 | 18520 | 18520.02 | Ovarian array | 3317-3376 |
| DEX0455_056.nt.1 | 3143 | 3143.0 | Lung array | 3107-3166 |
| DEX0455_056.nt.1 | 1582 | 1582.0 | Lung array | 3317-3376 |
| DEX0455_056.nt.1 | 22734 | 22734.02 | Ovarian array | 3317-3376 |
| DEX0455_056.nt.1 | 2661 | 2661.0 | Lung array | 3523-3582 |
| DEX0455_056.nt.2 | 23444 | 23444.01 | Ovarian array | 2559-2618 |
| DEX0455_056.nt.2 | 2661 | 2661.0 | Lung array | 3287-3346 |
| DEX0455_056.nt.2 | 3161 | 3161.0 | Lung array | 2518-2577 |
| DEX0455_056.nt.2 | 1582 | 1582.0 | Lung array | 3081-3140 |
| DEX0455_056.nt.2 | 22734 | 22734.02 | Ovarian array | 3081-3140 |
| DEX0455_056.nt.2 | 3160 | 3160.0 | Lung array | 2559-2618 |
| DEX0455_056.nt.2 | 18520 | 18520.02 | Ovarian array | 3081-3140 |
| DEX0455_056.nt.2 | 3165 | 3165.0 | Lung array | 3041-3100 |
| DEX0455_056.nt.2 | 1583 | 1583.0 | Lung array | 3041-3100 |
| DEX0455_056.nt.2 | 3164 | 3164.0 | Lung array | 3081-3140 |
| DEX0455_057.nt.1 | 7613 | 7613.0 | Lung array | 292-351 |

-continued

| DEX NT ID | Oligo ID | Oligo Name | Chip Name | Oligo Location |
|---|---|---|---|---|
| DEX0455_057.nt.1 | 33332 | 33332.02 | Prostate1 array | 600-659 |
| DEX0455_057.nt.1 | 7612 | 7612.0 | Lung array | 381-440 |
| DEX0455_057.nt.1 | 24524 | 24524.02 | Ovarian array | 600-659 |
| DEX0455_057.nt.2 | 7613 | 7613.0 | Lung array | 458-517 |
| DEX0455_057.nt.2 | 7612 | 7612.0 | Lung array | 547-606 |
| DEX0455_057.nt.2 | 33332 | 33332.02 | Prostate1 array | 766-825 |
| DEX0455_058.nt.1 | 14656 | 14656.02 | Ovarian array | 555-614 |
| DEX0455_059.nt.1 | 17372 | 17372.01 | Ovarian array | 1778-1837 |
| DEX0455_059.nt.1 | 11469 | 11469.02 | Ovarian array | 424-483 |
| DEX0455_059.nt.1 | 17370 | 17370.01 | Ovarian array | 957-1016 |
| DEX0455_059.nt.2 | 17372 | 17372.01 | Ovarian array | 1489-1548 |
| DEX0455_059.nt.2 | 11469 | 11469.02 | Ovarian array | 424-483 |
| DEX0455_060.nt.1 | 10372 | 10372.01 | Ovarian array | 1201-1260 |
| DEX0455_060.nt.1 | 18582 | 18582.01 | Ovarian array | 672-731 |
| DEX0455_061.nt.1 | 78508 | 78508.0 | Multi-Cancer array | 3736-3795 |
| DEX0455_061.nt.1 | 103529 | 103529.01 | Ovarian array | 3740-3799 |
| DEX0455_061.nt.1 | 19803 | 19803.0 | Colon array | 3736-3795 |
| DEX0455_061.nt.1 | 96523 | 96523.02 | Ovarian array | 3740-3799 |
| DEX0455_061.nt.1 | 19804 | 19804.0 | Colon array | 3684-3743 |
| DEX0455_061.nt.2 | 19803 | 19803.0 | Colon array | 4690-4749 |
| DEX0455_061.nt.2 | 78508 | 78508.0 | Multi-Cancer array | 4690-4749 |
| DEX0455_061.nt.2 | 19804 | 19804.0 | Colon array | 4638-4697 |
| DEX0455_061.nt.2 | 103529 | 103529.01 | Ovarian array | 4694-4753 |
| DEX0455_061.nt.2 | 96523 | 96523.02 | Ovarian array | 4694-4753 |
| DEX0455_061.nt.3 | 19803 | 19803.0 | Colon array | 4556-4615 |
| DEX0455_061.nt.3 | 78508 | 78508.0 | Multi-Cancer array | 4556-4615 |
| DEX0455_061.nt.3 | 103529 | 103529.01 | Ovarian array | 4560-4619 |
| DEX0455_061.nt.3 | 19804 | 19804.0 | Colon array | 4504-4563 |
| DEX0455_061.nt.3 | 96523 | 96523.02 | Ovarian array | 4560-4619 |
| DEX0455_061.nt.4 | 103529 | 103529.01 | Ovarian array | 1702-1761 |
| DEX0455_061.nt.4 | 19804 | 19804.0 | Colon array | 1646-1705 |
| DEX0455_061.nt.4 | 78508 | 78508.0 | Multi-Cancer array | 1698-1757 |
| DEX0455_061.nt.4 | 19803 | 19803.0 | Colon array | 1698-1757 |
| DEX0455_061.nt.4 | 96523 | 96523.02 | Ovarian array | 1702-1761 |
| DEX0455_061.nt.5 | 78508 | 78508.0 | Multi-Cancer array | 2394-2453 |
| DEX0455_061.nt.5 | 103529 | 103529.01 | Ovarian array | 2398-2457 |
| DEX0455_061.nt.5 | 19803 | 19803.0 | Colon array | 2394-2453 |
| DEX0455_061.nt.5 | 19804 | 19804.0 | Colon array | 2342-2401 |
| DEX0455_061.nt.5 | 96523 | 96523.02 | Ovarian array | 2398-2457 |
| DEX0455_062.nt.1 | 18094 | 18094.01 | Ovarian array | 914-973 |
| DEX0455_062.nt.1 | 17464 | 17464.02 | Ovarian array | 1167-1226 |

Example 2b

Relative Quantitation of Gene Expression

Real-Time quantitative PCR with fluorescent Taqman® probes is a quantitation detection system utilizing the 5'-3' nuclease activity of Taq DNA polymerase. The method uses an internal fluorescent oligonucleotide probe (Taqman®) labeled with a 5' reporter dye and a downstream, 3' quencher dye. During PCR, the 5'-3' nuclease activity of Taq DNA polymerase releases the reporter, whose fluorescence can then be detected by the laser detector of the Model 7700 Sequence Detection System (PE Applied Biosystems, Foster City, Calif., USA). Amplification of an endogenous control is used to standardize the amount of sample RNA added to the reaction and normalize for Reverse Transcriptase (RT) efficiency. Either cyclophilin, glyceraldehyde-3-phosphate dehydrogenase (GAPDH), ATPase, or 18S ribosomal RNA (rRNA) is used as this endogenous control. To calculate relative quantitation between all the samples studied, the target RNA levels for one sample were used as the basis for comparative results (calibrator). Quantitation relative to the "calibrator" can be obtained using the comparative method (User Bulletin #2: ABI PRISM 7700 Sequence Detection System).

The tissue distribution and the level of the target gene are evaluated for every sample in normal and cancer tissues. Total RNA is extracted from normal tissues, cancer tissues, and from cancers and the corresponding matched adjacent tissues. Subsequently, first strand cDNA is prepared with reverse transcriptase and the polymerase chain reaction is done using primers and Taqman® probes specific to each target gene. The results are analyzed using the ABI PRISM 7700 Sequence Detector. The absolute numbers are relative levels of expression of the target gene in a particular tissue compared to the calibrator tissue.

One of ordinary skill can design appropriate primers. The relative levels of expression of the OSNA versus normal tissues and other cancer tissues can then be determined. All the values are compared to the calibrator. Normal RNA samples are commercially available pools, originated by pooling samples of a particular tissue from different individuals.

The relative levels of expression of the OSNA in pairs of matched samples may also be determined. A matched pair is formed by mRNA from the cancer sample for a particular tissue and mRNA from the normal adjacent sample for that same tissue from the same individual. All the values are compared to the calibrator.

In the analysis of matching samples, the OSNAs show a high degree of tissue specificity for the tissue of interest. These results confirm the tissue specificity results obtained with normal pooled samples. Further, the level of mRNA expression in cancer samples and the isogenic normal adjacent tissue from the same individual are compared. This comparison provides an indication of specificity for the cancer state (e.g. higher levels of mRNA expression in the cancer sample compared to the normal adjacent).

Information on the samples tested in the QPCR experiments below include the Sample ID (Smpl ID), Organ, Tissue Type (Tiss Type), Diagnosis (DIAG), Disease Detail, and Stage or Grade (STG or GRD) in following table.

| Sample ID | ORGAN | TISS TYPE | DIAGNOSIS | DISEASE DETAIL | STAGE OR GRADE |
|---|---|---|---|---|---|
| A084 | Ovary | CAN | | Mucinous borderline tumor | |
| A084 | Ovary | NAT | NAT | | |
| G010 | Ovary | CAN | Adenocarcinoma | Adenocarcinoma | Stage III |
| G010 | Ovary | NAT | | NAT | |
| G021 | Ovary | CAN | Carcinoma | St. IIIC, poorly diff. | Stage-IIIC, poorly diff. |
| G021 | Ovary | NAT | | NAT | |
| 1157 | Ovary | CAN | | malignant tumor | |
| 773O | Ovary | CAN | Papillary adenocarcinoma | serous papillary adenocarcinoma | metastatic |
| 814O | Ovary | CAN | | Papillary Serous Adenocarcinoma | Stage IV |
| C360 | Ovary | CAN | Adenocarcinoma | endometrioid adenocarcinoma | |
| 1005O | Ovary | CAN | | papillary serous and endometrioid ovarian carcinoma, concurrent metastatic breast cancer | 3 |
| 1040O | Ovary | CAN | | papillary serous adeno, metastatic | |
| 105O | Ovary | CAN | | Papillary Serous Carcinoma with Focal Mucinous Differentiation | Stage IC G0; T1cN0M0 |
| 130X | Ovary | CAN | | Ovarian cancer | |
| 718O | Ovary | CAN | Adenocarcinoma | malignant tumor | IIIC |
| A1B | Ovary | CAN | Adenocarcinoma | CA | |
| 988Z | Ovary | CAN | | papillary serous adenocarcinoma | poorly diff, FIGO IIIC |
| 451O | Ovary | NRM | | Normal Tissue | |
| 247A | Ovary | NRM | | NL | |
| 35GA | Ovary | NRM | | NL | |
| C087 | Ovary | NRM | | NL | |
| C109 | Ovary | NRM | | NL | |
| 206I | Ovary | NRM | | NL | |
| 515O | Ovary | NRM | | Normal | |
| 18GA | Ovary | NRM | | NL | |
| 337O | Ovary | NRM | | Normal | |
| 123O | Ovary | NRM | | Normal | |
| C177 | Ovary | NRM | | several fluid filled cysts | |
| 40G | Ovary | NRM | | NL | |
| C004 | Ovary | NRM | | NL | |
| 030B | Urinary Bladder | CAN | Carcinoma | invasive Carcinoma, poorly differentiated | Stage III, Grade 3 |
| 030B | Urinary Bladder | NAT | | NAT | |
| TR17 | Urinary Bladder | CAN | Carcinoma | transitional cell carcinoma | StageII/Grade III |
| TR17 | Urinary Bladder | NAT | | NAT | |
| 520B | Urinary Bladder | CAN | Sarcomatoid transitional cell carcinoma | Sarcomatoid transitional cell carcinoma | |
| 520B | Urinary Bladder | NAT | | NAT | |
| 401C | Colon | CAN | Adenocarcinoma | Adenocarcinoma of ascending colon and cecum | Stage III |
| 401C | Colon | NAT | | NAT | |
| AS43 | Colon | CAN | Adenocarcinoma | malignant | |
| AS43 | Colon | NAT | Adenocarcinoma | NAT | |

-continued

| Sample ID | ORGAN | TISS TYPE | DIAGNOSIS | DISEASE DETAIL | STAGE OR GRADE |
|---|---|---|---|---|---|
| AS98 | Colon | CAN | Adenocarcinoma | Moderately to poorly differentiated adenocarcinoma | Duke's C |
| AS98 | Colon | NAT | | NAT | |
| CM12 | Colon | CAN | | T | Stage D |
| CM12 | Colon | NAT | Adenocarcinoma | Nat | |
| DC19 | Colon | CAN | | T | Stage B |
| DC19 | Colon | NAT | | NL | |
| RC01 | Colon | CAN | Cancer | | Stage IV |
| RC01 | Colon | NAT | | NAT | |
| RS53 | Colon | CAN | Adenocarcinoma | moderately differentiated | |
| RS53 | Colon | NAT | Adenocarcinoma | NAT | |
| SG27 | Colon | CAN | | malig | Stage B |
| SG27 | Colon | NAT | | NAT | |
| TX01 | Colon | CAN | Adenocarcinoma | Moderately differentiated adenocarcinoma of cecum | Stage II; T3NoMo |
| TX01 | Colon | NAT | | NAT | |
| KS52 | Cervix | CAN | Squamous cell carcinoma | Keratinizing Squamous Cell Carcinoma | IIIB, well diff. G1; T3bNxM0 |
| KS52 | Cervix | NAT | | NAT | |
| NK23 | Cervix | CAN | | Nonkeratinizing Large Cell | FIGO IIIB, undiff. G4; T3bNxM0 |
| NK23 | Cervix | NAT | | NAT | |
| NKS54 | Cervix | CAN | Squamous cell carcinoma | Nonkeratinizing Squamous Cell Carcinoma | IIB, mod diff. G2; T2bNxM0 |
| NKS54 | Cervix | NAT | | NAT | |
| NKS55 | Cervix | CAN | Squamous cell carcinoma | Nonkeratinizing Squamous Cell Carcinoma | IIIB, Mod diff. G2; T3bNxM0 |
| NKS55 | Cervix | NAT | | NAT | |
| NKS81 | Cervix | CAN | Squamous cell carcinoma | large cell nonkeratinizing sq carc, IIB, moderately diff | IIB |
| NKS81 | Cervix | NAT | | NAT | |
| NKS25 | Cervix | CAN | | | |
| NKS25 | Cervix | NAT | | NAT | |
| NKS18 | Cervix | CAN | Squamous cell carcinoma | Nonkeratinizing squamous cell carcinoma | GII |
| NKS18 | Cervix | NAT | | NAT | |
| 10479 | Endometrium | CAN | | malignant mixed mullerian tumor | T?, Nx, M1 |
| 10479 | Endometrium | NAT | | NAT | |
| 28XA | Endometrium | CAN | Endometrial adenocarcinoma | malignant | II/III |
| 28XA | Endometrium | NAT | | NAT | II/III |
| 8XA | Endometrium | CAN | mod. diff, invasive, squamous differentiation, FIGO-II | | |
| 8XA | Endometrium | NAT | | NAT | |
| 106XD | Kidney | CAN | Renal cell carcinoma | renal cell carcinoma, clear cell, localized | 3 |
| 106XD | Kidney | NAT | | NL | |
| 107XD | Kidney | CAN | Renal cell carcinoma | renal cell carcinoma, clear cell, with metastatic | G III |
| 107XD | Kidney | NAT | | NL | |
| 109XD | Kidney | CAN | | Malignant | G III |
| 109XD | Kidney | NAT | | NL | |
| 10XD | Kidney | CAN | Renal cell carcinoma | renal cell carcinoma, clear cell, localized, grade 2-3 | 3 |

-continued

| Sample ID | ORGAN | TISS TYPE | DIAGNOSIS | DISEASE DETAIL | STAGE OR GRADE |
|---|---|---|---|---|---|
| 10XD | Kidney | NAT | | NL | |
| 22K | Kidney | CAN | Renal cell carcinoma | Renal cell carcinoma | G2, Mod. Diff. |
| 22K | Kidney | NAT | | NAT | |
| 12XD | Kidney | CAN | Renal cell carcinoma | Left renal cell carcinoma | |
| 12XD | Kidney | NAT | | NAT | |
| 15XA | Liver | CAN | | Sarcoma, Retroperitoneal Tumor | Grade-2 |
| 15XA | Liver | NAT | | CA | St. I, G4 |
| 174L | Liver | CAN | Hepatocellular carcinoma | Moderate to well differentiated hepatocellular carcinoma | |
| 174L | Liver | NAT | Hepatocellular carcinoma | NAT | |
| 187L | Liver | CAN | Adenocarcinoma | Metastatic Adenocarcinoma | Liver (Gallbladder) |
| 187L | Liver | NAT | | NAT | |
| 205L | Lung | CAN | Adenocarcinoma | poorly differentiated adenocarcinoma | T2, N1, Mx |
| 205L | Lung | NAT | | NAT | |
| 315L | Lung | CAN | Squamous cell carcinoma | | |
| 315L | Lung | NAT | Adenocarcinoma | NAT | |
| 507L | Lung | CAN | Bronchioloalveolar carcinoma | bronchioalveolar carcinoma | Stage IB, G1, well diff. |
| 507L | Lung | NAT | | NAT | |
| 528L | Lung | CAN | Adenocarcinoma | Adenocarcinoma | St.IV, T2N0 M1, infiltrating poorly diff. |
| 528L | Lung | NAT | | NAT | |
| 8837L | Lung | CAN | Squamous cell carcinoma | Squamous cell carcinoma | T2, N0, M0 |
| 8837L | Lung | NAT | | NAT | |
| AC11 | Lung | CAN | Adenocarcinoma | poorly differentiated adenocarcinoma | T2, N2, M1 |
| AC11 | Lung | NAT | | NAT | |
| AC39 | Lung | CAN | Adenocarcinoma | intermediate grade adnocarcinoma | T2, N2, Mx |
| AC39 | Lung | NAT | | NAT | |
| SQ80 | Lung | CAN | Squamous cell carcinoma | poorly differentiated squamous cell carcinoma | T1, N1, M0 |
| SQ80 | Lung | NAT | | NAT | |
| SQ81 | Lung | CAN | Squamous cell carcinoma | poorly differentiated squamous carcinoma | T3, N1, Mx |
| SQ81 | Lung | NAT | | NAT | |
| 19DN | Mammary | CAN | Invasive ductal carcinoma | Invasive ductal carcinoma | G3, Stage IIA; T2N0M0 |
| 19DN | Mammary | NAT | | NAT | |
| 42DN | Mammary | CAN | Invasive ductal carcinoma | Invasive Ductal Carcinoma | T3aN1M0 IIIA, G3 |
| 42DN | Mammary | NAT | | NAT | |
| 517 | Mammary | CAN | Infiltrating ductal carcinoma | Infiltrating ductal carcinoma | St. IIA, G3 |
| 517 | Mammary | NAT | | NAT | |
| 781M | Mammary | CAN | Invasive ductal carcinoma | | Architectural grade-3/3, Nuclear grade-3/3 |
| 781M | Mammary | NAT | | NAT | |
| 869M | Mammary | CAN | Invasive carcinoma | Invasive Carcinoma | Stage IIA G1; T2NoMo |
| 869M | Mammary | NAT | | NAT | |

-continued

| Sample ID | ORGAN | TISS TYPE | DIAGNOSIS | DISEASE DETAIL | STAGE OR GRADE |
|---|---|---|---|---|---|
| 976M | Mammary | CAN | Invasive ductal carcinoma | Invasive Ductal Carcinoma | T2N1M0 (Stage 2B Grade 2-3) |
| 976M | Mammary | NAT | | NAT | |
| S570 | Mammary | CAN | Carcinoma | Carcinoma | Stage IIA; T1N1Mo |
| S570 | Mammary | NAT | | NAT | |
| S699 | Mammary | CAN | Invasive lobular carcinoma | Invasive Lobular Carcinoma | Stage IIB G1; T2N1Mo |
| S699 | Mammary | NAT | | NAT | |
| S997 | Mammary | CAN | Invasive ductal carcinoma | Invasive Ductal Carcinoma | Stage IIB G3; T2N1Mo |
| S997 | Mammary | NAT | | NAT | |
| 71XL | Pancreas | CAN | | villous adenoma with paneth cell metaplasia | localized |
| 71XL | Pancreas | NAT | | NL | |
| 82XP | Pancreas | CAN | | serious cystadenoma | |
| 82XP | Pancreas | NAT | | NL | |
| 92X | Pancreas | CAN | Ductal adenocarcinoma | ductal adenocarcinoma | mod to focally poorly diff. |
| 92X | Pancreas | NAT | | NL | |
| 77X | Pancreas | CAN | Hepatic adenoma | Hepatic adenoma | |
| 77X | Pancreas | NAT | | NL | |
| 23B | Prostate | CAN | | Prostate tumor | Gleason's 3 + 4 |
| 23B | Prostate | NAT | | NAT | |
| 65XB | Prostate | CAN | Adenocarcinoma | adenocarcinom | 3 + 4 = 7 |
| 65XB | Prostate | NAT | | NL | |
| 675P | Prostate | CAN | Adenocarcinoma | adenocarcinoma | |
| 675P | Prostate | NAT | | Normal | |
| 84XB | Prostate | CAN | Adenocarcinoma | adenocarcinom | 2 + 3 |
| 84XB | Prostate | NAT | | NL | |
| 958P | Prostate | CAN | Adenocarcinoma | Adenocarcinoma | T2C, NO, MX |
| 958P | Prostate | NAT | NAT | Normal | |
| 263C | Prostate | BPH | | BPH | |
| 276P | Prostate | BPH | | BPH | |
| 767B | Prostate | BPH | | prostate BPH | |
| 855P | Prostate | BPH | | BPH | |
| 10R | Prostate | PROST | | active chronic prostatitis | T0, N0, M0 |
| 20R | Prostate | PROST | | PROSTATITIS | |
| 287S | Skin | CAN | Squamous cell carcinoma | Invasive Keratinizing Squamous Cell Carcinoma | Moderately Differentiated |
| 287S | Skin | NAT | | NAT | |
| 39A | Skin | CAN | | CA | St. II |
| 39A | Skin | NAT | | CA | St. II |
| 669S | Skin | CAN | Melanoma | Nodular malignant melanoma | |
| 669S | Skin | NAT | | NAT | |
| 171S | Small Intestine | CAN | Adenocarcinoma | Moderately differentiated Adenocarcinoma, invasive | |
| 171S | Small Intestine | NAT | | NAT | |
| 20SM | Small Intestine | CAN | Adenocarcinoma | Adenocarcinoma, metastic to lung & liver | St. IV, poorly diff. |
| 20SM | Small Intestine | NAT | | NAT | |
| H89 | Small Intestine | CAN | Adenocarcinoma | Adenocarcinoma | 80% tumor, 50% necrosis, moderately differentiated, G2-3; T3N1MX |
| H89 | Small Intestine | NAT | Adenocarcinoma | NAT | |

-continued

| Sample ID | ORGAN | TISS TYPE | DIAGNOSIS | DISEASE DETAIL | STAGE OR GRADE |
|---|---|---|---|---|---|
| 261S | Stomach | CAN | Signet-ring cell carcinoma | Signet-ring cell carcinoma | Stage IIIA, T3N1M0 |
| 261S | Stomach | NAT | | NAT | |
| 288S | Stomach | CAN | Adenocarcinoma | Infiltrating Adneocarcinoma | Moderately Differentiated |
| 288S | Stomach | NAT | | NAT | |
| AC93 or 509L | Stomach | CAN | Adenocarcinoma | Adenocarcinoma | St. IV, G4, T4N3M0, poorly diff. |
| AC93 or 509L | Stomach | NAT | | NAT | |
| 88S | Stomach | CAN | Adenocarcinoma | Mucinous adenocarcinoma | T3N1M0, St. IIIA |
| 88S | Stomach | NAT | | NAT | |
| 143N | Thyroid Gland | CAN | Follicular carcinoma | Follicular Carcinoma | |
| 143N | Thyroid Gland | NAT | | NAT | |
| 270T | Thyroid Gland | CAN | | CA | |
| 270T | Thyroid Gland | NAT | | NAT | |
| 56T | Thyroid Gland | CAN | Papillary carcinoma | Papillary Carcinoma | St. III; T4N1M0 |
| 56T | Thyroid Gland | NAT | | NAT | |
| 39X | Testes | CAN | | CA | |
| 39X | Testes | NAT | | NAT | |
| 647T | Testes | CAN | Teratocarcinoma | Teratocarcinoma | Stage IA |
| 647T | Testes | NAT | Teratocarcinoma | NAT | |
| 663T | Testes | CAN | Teratocarcinoma | Teratocarcinoma | |
| 663T | Testes | NAT | | NAT | |
| 135XO | Uterus | CAN | | Uterus normal | |
| 135XO | Uterus | NAT | | Uterus tumor | |
| 85XU | Uterus | CAN | | endometrial carcinoma | I |
| 85XU | Uterus | NAT | | NL | |
| B1 | Blood | NRM | | Normal | |
| B3 | Blood | NRM | | Normal | |
| B5 | Blood | NRM | | Normal | |
| B6 | Blood | NRM | | Normal | |
| B11 | Blood | NRM | | Normal | |
| 982B | Blood | NRM | | Normal | |
| B69 | Blood | NRM | | Normal | |
| B72 | Blood | NRM | | Normal | |
| B73 | Blood | NRM | | Normal | |
| B75 | Blood | NRM | | Normal | |
| 48AD | Adrenal Gland | NRM | | Normal | |
| 10BR | Brain | NRM | | Normal | |
| 01CL | Colon | NRM | | Normal | |
| 06CV | Cervix | NRM | | Normal | |
| 01ES | Esophagus | NRM | | Normal | |
| 46HR | Heart | NRM | | Normal | |
| 00HR | Human Reference | CAN | CAN | Cancer pool | |
| 55KD | Kidney | NRM | | Normal | |
| 89LV | Liver | NRM | | Normal | |
| 90LN | Lung | NRM | | Normal | |
| 01MA | Mammary | NRM | | Normal | |
| 84MU | Skeletal Muscle | NRM | | Normal | |
| 3APV | Ovary | NRM | | Normal | |
| 04PA | Pancreas | NRM | | Normal | |
| 59PL | Placenta | NRM | | Normal | |
| 09PR | Prostate | NRM | | Normal | |
| 21RC | Rectum | NRM | | Normal | |
| 59SM | Small Intestine | NRM | | Normal | |
| 7GSP | Spleen | NRM | | Normal | |
| 09ST | Stomach | NRM | | Normal | |
| 4GTS | Testes | NRM | | Normal | |

| Sample ID | ORGAN | TISS TYPE | DIAGNOSIS | DISEASE DETAIL | STAGE OR GRADE |
|---|---|---|---|---|---|
| 99TM | Thymus Gland | NRM | | Normal | |
| 16TR | Trachea | NRM | | Normal | |
| 57UT | Uterus | NRM | | Normal | |

DEX0455_019.nt.1 (Ovr224)

The relative expression level of Ovr224 in various tissue samples is included below. Tissue samples include 68 pairs of matching samples, 10 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 4 were blood samples which measured the expression levels in blood cells. Additionally, 2 prostatitis, and 4 Benign Prostatic Hyperplasia (BPH) samples are included. All the values are compared to ovarian cancer sample OVR7730 (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.01 | 0.00 | | | |
| OVRG010 | 0.00 | 0.06 | | | |
| OVRG021 | 0.03 | 0.03 | | | |
| OVR1157 | 0.36 | | | | |
| OVR7730 | 1.00 | | | | |
| OVR814O | 0.02 | | | | |
| OVRC360 | 0.02 | | | | |
| OVR1005O | 0.35 | | | | |
| OVR1040O | 0.10 | | | | |
| OVR105O | 0.00 | | | | |
| OVR130X | 0.44 | | | | |
| OVR718O | 0.02 | | | | |
| OVRA1B | 0.04 | | | | |
| OVR247A | | | 0.00 | | |
| OVR35GA | | | 0.00 | | |
| OVRC087 | | | 0.00 | | |
| OVRC109 | | | 0.00 | | |
| OVR206I | | | 0.00 | | |
| OVR515O | | | 0.00 | | |
| OVR18GA | | | 0.00 | | |
| OVR337O | | | 0.00 | | |
| OVR123O | | | 0.00 | | |
| OVRC177 | | | 0.02 | | |
| OVR40G | | | 0.00 | | |
| OVRC004 | | | 0.00 | | |
| BLD030B | 0.00 | 0.00 | | | |
| BLDTR17 | 0.00 | 0.03 | | | |
| CLN401C | 0.00 | 0.00 | | | |
| CLNAS98 | 0.02 | 0.00 | | | |
| CLNCM12 | 0.00 | 0.02 | | | |
| CLNDC19 | 0.02 | 0.00 | | | |
| CLNRC01 | 0.00 | 0.01 | | | |
| CLNRS53 | 0.14 | 0.00 | | | |
| CLNSG27 | 0.00 | 0.00 | | | |
| CLNTX01 | 0.00 | 0.00 | | | |
| CVXKS52 | 0.00 | 0.03 | | | |
| CVXNK23 | 0.01 | 0.00 | | | |
| CVXNKS54 | 0.00 | 0.25 | | | |
| CVXNKS55 | 0.06 | 0.17 | | | |
| CVXNKS81 | 0.87 | 0.00 | | | |
| ENDO10479 | 0.03 | 0.00 | | | |
| ENDO28XA | 0.00 | 0.00 | | | |
| ENDO8XA | 0.02 | 0.00 | | | |
| KID106XD | 0.00 | 0.08 | | | |
| KID107XD | 0.00 | 0.07 | | | |
| KID109XD | 0.06 | 0.37 | | | |
| KID10XD | 0.00 | 0.02 | | | |
| KID22K | 0.00 | 0.00 | | | |
| LNG205L | 0.00 | 0.33 | | | |
| LNG315L | 0.00 | 0.53 | | | |
| LNG507L | 0.21 | 0.43 | | | |
| LNG528L | 0.00 | 2.39 | | | |
| LNG8837L | 0.02 | 0.13 | | | |
| LNGAC11 | 0.32 | 0.23 | | | |
| LNGSQ80 | 0.00 | 0.00 | | | |
| LVR187L | 0.00 | 0.04 | | | |
| MAM19DN | 0.00 | 0.00 | | | |
| MAM42DN | 0.13 | 0.00 | | | |
| MAM517 | 0.62 | 0.00 | | | |
| MAM781M | 0.00 | 0.00 | | | |
| MAM869M | 0.00 | 0.42 | | | |
| MAM976M | 0.00 | 0.00 | | | |
| MAMS570 | 0.00 | 0.00 | | | |
| MAMS699 | 0.00 | 0.00 | | | |
| MAMS997 | 0.00 | 0.00 | | | |
| PAN71XL | 0.01 | 0.04 | | | |
| PAN82XP | 0.01 | 0.00 | | | |
| PAN92X | 0.00 | 0.00 | | | |
| PRO23B | 0.02 | 0.03 | | | |
| PRO65XB | 0.01 | 0.02 | | | |
| PRO675P | 0.07 | 0.00 | | | |
| PRO84XB | 0.02 | 0.09 | | | |
| PRO958P | 0.00 | 0.04 | | | |
| PRO263C | | | | 0.00 | |
| PRO276P | | | | 0.00 | |
| PRO767B | | | | 0.04 | |
| PRO855P | | | | 0.00 | |
| PRO10R | | | | | 0.00 |
| PRO20R | | | | | 0.00 |
| SKN287S | 0.00 | 0.00 | | | |
| SKN39A | 0.62 | 0.73 | | | |
| SKN669S | 0.02 | 0.00 | | | |
| SMINT171S | 0.00 | 0.00 | | | |
| SMINT20SM | 0.04 | 0.00 | | | |
| SMINTH89 | 0.01 | 0.00 | | | |
| STO261S | 0.00 | 0.00 | | | |
| STO288S | 0.00 | 0.03 | | | |
| STO88S | 0.04 | 0.03 | | | |
| THRD143N | 0.00 | 0.04 | | | |
| THRD270T | 0.05 | 0.03 | | | |
| THRD56T | 0.44 | 0.05 | | | |
| TST39X | 0.00 | 0.33 | | | |
| TST647T | 0.02 | 0.07 | | | |
| TST663T | 0.05 | 0.01 | | | |
| UTR135XO | 0.05 | 0.00 | | | |
| UTR85XU | 0.03 | 0.00 | | | |
| BLOB1 | | | 9.03 | | |
| BLOB3 | | | 0.71 | | |
| BLOB6 | | | 5.37 | | |
| BLOB11 | | | 3.85 | | |
| BLO982B | | | 0.93 | | |
| ADR48AD | | | 0.00 | | |
| BRN10BR | | | 0.00 | | |
| CLN01CL | | | 0.00 | | |
| ESO01ES | | | 0.22 | | |
| HRT46HR | | | 0.00 | | |

-continued

| Sample ID | CAN | NAT | NRM | BPH | PROST |
|---|---|---|---|---|---|
| HUMREF00HR | 0.00 | | | | |
| KID55KD | | 0.03 | | | |
| LVR89LV | | 0.00 | | | |
| LNG90LN | | 0.01 | | | |
| MAM01MA | | 0.00 | | | |
| MSL84MU | | 0.00 | | | |
| OVR3APV | | 0.01 | | | |
| PAN04PA | | 0.00 | | | |
| PLA59PL | | 0.00 | | | |
| PRO09PR | | 0.00 | | | |
| REC21RC | | 0.00 | | | |
| SMINT59SM | | 0.01 | | | |
| SPL7GSP | | 0.63 | | | |
| STO09ST | | 0.00 | | | |
| THYM99TM | | 0.00 | | | |
| TRA16TR | | 0.00 | | | |
| TST4GTS | | 0.03 | | | |
| UTR57UT | | 0.00 | | | |

Note:
0.00 = Negative or Not Detected

The sensitivity for Ovr224 expression was calculated for the cancer samples versus normal samples. The sensitivity value indicates the percentage of cancer samples that show levels of Ovr224 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr224 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 44% | 0% | 22% | 0% | 20% |
| Sensitivity, Down vs. NAT | 22% | 56% | 11% | 0% | 40% |
| Sensitivity, Up vs. NRM | 44% | 33% | 22% | 92% | 80% |
| Sensitivity, Down vs. NRM | 0% | 44% | 0% | 0% | 0% |
| Specificity | 47.03% | 54.59% | 45.41% | 56% | 52.41% |

Altogether, the tissue specificity, plus the mRNA differential expression in the samples tested are believed to make Ovr224 a good marker for diagnosing, monitoring, staging, imaging and/or treating ovarian cancer.

Primers used for QPCR Expression Analysis of Ovr224 are as follows:

```
(Ovr224_forward):  TCCTCAAGGGCCCTCCCCAG                      (SEQ ID NO: 296)

(Ovr224_reverse):  CCACAGCCATCTCCTCCATATTCTG                 (SEQ ID NO: 297)

(Ovr224_probe):    AAGTGTTCCTCTGGATGACCTACCTGG               (SEQ ID NO: 298)
```

DEX0455__031.nt.2 (Cln257)

The relative expression level of Cln257 in various tissue samples is included below. Tissue samples include 78 pairs of matching samples, 6 non matched cancer samples, and 35 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to normal colon sample CLN01CL (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| CLNAS12 | 5.55 | 10.39 | | | |
| CLNAS46 | 6.28 | 3.22 | | | |
| CLNB34 | 1.78 | 3.88 | | | |
| CLNC9XR | 2.76 | 3.35 | | | |
| CLNCM67 | 2.91 | 2.44 | | | |
| CLNTX89 | 6.56 | 5.08 | | | |
| CLNAS43 | 27.92 | 6.39 | | | |
| CLNAS98 | 6.93 | 5.42 | | | |
| CLNRS53 | 8.04 | 6.77 | | | |
| CLNRC01 | 9.91 | 2.51 | | | |
| CLNSG27 | 4.56 | 7.39 | | | |
| CLNDC19 | 3.97 | 3.84 | | | |
| CLN401C | 7.09 | 4.98 | | | |
| CLNCM12 | 3.28 | 6.25 | | | |
| CLNTX01 | 16.34 | 8.61 | | | |
| BLD030B | 2.29 | 2.59 | | | |
| BLD520B | 12.82 | 14.74 | | | |
| BLDTR17 | 10.50 | 5.28 | | | |
| CVXKS52 | 12.36 | 17.89 | | | |
| CVXNK23 | 12.42 | 62.77 | | | |
| CVXNKS54 | 24.16 | 13.33 | | | |
| CVXNKS55 | 15.58 | 17.45 | | | |
| CVXNKS81 | 84.82 | 132.51 | | | |
| ENDO10479 | 15.86 | 25.40 | | | |
| ENDO28XA | 12.96 | 13.04 | | | |
| ENDO8XA | 12.25 | 3.60 | | | |
| KID106XD | 0.32 | 1.89 | | | |
| KID107XD | 29.14 | 4.27 | | | |
| KID109XD | 8.21 | 5.31 | | | |
| KID10XD | 5.61 | 0.84 | | | |
| KID22K | 2.84 | 1.47 | | | |
| LNG205L | 8.83 | 9.05 | | | |
| LNG315L | 16.63 | 28.85 | | | |
| LNG507L | 13.87 | 27.96 | | | |
| LNG528L | 20.05 | 27.89 | | | |
| LNG8837L | 16.21 | 10.02 | | | |
| LNGAC11 | 15.21 | 14.83 | | | |
| LNGAC39 | 49.00 | 16.41 | | | |
| LNGSQ80 | 18.40 | 11.35 | | | |
| LNGSQ81 | 7.80 | 54.12 | | | |
| LVR15XA | 9.04 | 2.93 | | | |
| LVR174L | 4.08 | 6.13 | | | |
| LVR187L | 3.52 | 3.60 | | | |
| MAM19DN | 14.68 | 14.78 | | | |
| MAM42DN | 12.41 | 26.01 | | | |
| MAM517 | 133.69 | 12.41 | | | |
| MAM781M | 23.89 | 12.22 | | | |
| MAM869M | 7.84 | 17.28 | | | |
| MAM976M | 39.22 | 32.92 | | | |
| MAMS570 | 21.06 | 26.04 | | | |
| MAMS699 | 6.70 | 0.00 | | | |
| MAMS997 | 11.37 | 13.47 | | | |
| OVRG021 | 9.65 | 18.53 | | | |
| OVR1005O | 36.75 | | | | |
| OVR1040O | 14.88 | | | | |
| OVR105O | 8.82 | | | | |
| OVR130X | 32.30 | | | | |
| OVR718O | 22.87 | | | | |
| OVRA1B | 15.50 | | | | |
| OVR123O | | | 16.94 | | |

-continued

| Sample ID | CAN | NAT | NRM | BPH | PROST |
|---|---|---|---|---|---|
| OVR18GA | | | 13.92 | | |
| OVR206I | | | 15.98 | | |
| OVR337O | | | 13.28 | | |
| OVR40G | | | 20.23 | | |
| OVR515O | | | 26.97 | | |
| OVRC004 | | | 54.21 | | |
| OVRC177 | | | 6.97 | | |
| PAN71XL | 9.65 | 8.64 | | | |
| PAN82XP | 7.20 | 24.22 | | | |
| PAN92X | 8.74 | 26.55 | | | |
| PRO23B | 13.10 | 14.00 | | | |
| PRO65XB | 6.20 | 10.57 | | | |
| PRO675P | 20.64 | 27.15 | | | |
| PRO84XB | 10.46 | 10.35 | | | |
| PRO958P | 11.48 | 10.47 | | | |
| PRO263C | | | | 35.87 | |
| PRO276P | | | | 7.20 | |
| PRO767B | | | | 17.09 | |
| PRO855P | | | | 8.27 | |
| PRO10R | | | | | 16.92 |
| PRO20R | | | | | 15.27 |
| SKN287S | 8.51 | 9.87 | | | |
| SKN39A | 12.75 | 8.64 | | | |
| SKN669S | 8.95 | 23.59 | | | |
| SMINT171S | 9.57 | 15.19 | | | |
| SMINT20SM | 30.83 | 12.12 | | | |
| SMINTH89 | 10.91 | 10.48 | | | |
| STO261S | 16.09 | 3.67 | | | |
| STO288S | 8.76 | 3.43 | | | |
| STO88S | 14.77 | 4.27 | | | |
| THRD143N | 6.43 | 17.06 | | | |
| THRD270T | 25.28 | 27.05 | | | |
| THRD56T | 12.28 | 9.55 | | | |
| TST39X | 7.03 | 1.37 | | | |
| TST647T | 4.87 | 5.35 | | | |
| TST663T | 10.23 | 3.49 | | | |
| UTR135XO | 10.47 | 13.31 | | | |
| UTR85XU | 25.28 | 27.08 | | | |
| BLOB1 | | | 82.99 | | |
| BLOB3 | | | 15.84 | | |
| BLOB6 | | | 81.31 | | |
| BLOB11 | | | 12.68 | | |
| BLO982B | | | 3.82 | | |
| ADR48AD | | | 1.96 | | |
| HUMREF00HR | 0.94 | | | | |
| BRN10BR | | | 0.00 | | |
| CLN01CL | | | 1.00 | | |
| ESO01ES | | | 4.70 | | |
| HRT46HR | | | 0.59 | | |
| KID55KD | | | 0.58 | | |
| LVR89LV | | | 1.93 | | |
| LNG90LN | | | 3.14 | | |
| MAM01MA | | | 6.01 | | |
| MSL84MU | | | 0.21 | | |
| OVR3APV | | | 5.62 | | |
| PAN04PA | | | 3.59 | | |
| PLA59PL | | | 5.14 | | |
| PRO09PR | | | 3.40 | | |
| REC21RC | | | 8.88 | | |
| SMINT59SM | | | 3.09 | | |
| SPL7GSP | | | 3.91 | | |
| STO09ST | | | 2.19 | | |
| THYM99TM | | | 4.39 | | |
| TRA16TR | | | 6.32 | | |
| TST4GTS | | | 1.10 | | |
| UTR57UT | | | 14.36 | | |

0.00 = Negative or Not Detected

The sensitivity for Cln257 expression was calculated for the cancer samples versus normal samples. The sensitivity value indicates the percentage of cancer samples that show levels of Cln257 at least 2 fold higher than the normal tissue or the corresponding normal adjacent form the same patient.

This specificity is an indication of the level of colon tissue specific expression of the transcript compared to all the other tissue types tested in our assay. Thus, these experiments indicate Cln257 being useful as an colon cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 13% | 11% | 22% | 0% | 0% |
| Sensitivity, Down vs. NAT | 7% | 22% | 22% | 0% | 0% |
| Sensitivity, Up vs. NRM | 93% | 100% | 67% | 29% | 80% |
| Sensitivity, Down vs. NRM | 0% | 0% | 0% | 0% | 0% |
| Specificity | 3.47% | 6.49% | 5.95% | 6.42% | 5.35% |

Altogether, the tissue specificity, plus the mRNA differential expression in the samples tested are believed to make Cln257 a good marker for diagnosing, monitoring, staging, imaging and/or treating colon cancer.

Primers used for QPCR Expression Analysis of Cln257 are as follows:

```
                                           (SEQ ID NO: 299)
    (Cln257_forward):     CTGAAGCCGAGCTCAAAGGT (SEQ ID NO: 300)
    (Cln257_reverse):     CCCTGCTCCCACTTGAGATC (SEQ ID NO: 301)
    (Cln257_probe):       TGTGAAAAGGAGGCTGGGTGCCAG
```

DEX0455__034.nt.1 and DEX0455__034.nt.2 (Ovr223)

The relative expression level of Ovr223 in various tissue samples is included below. Tissue samples include 75 pairs of matching samples, 11 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 4 were blood samples which measured the expression levels in blood cells. Additionally, 2 prostatitis, and 4 Benign Prostatic Hyperplasia (BPH) samples are included. All the values are compared to ovarian cancer sample OVR7730 (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.12 | 0.05 | | | |
| OVRG010 | 0.04 | 0.24 | | | |
| OVRG021 | 0.16 | 0.05 | | | |
| OVR1157 | 0.32 | | | | |
| OVR7730 | 1.00 | | | | |
| OVR814O | 0.06 | | | | |
| OVRC360 | 0.00 | | | | |
| OVR1005O | 0.75 | | | | |
| OVR1040O | 0.97 | | | | |
| OVR105O | 0.80 | | | | |
| OVR130X | 2.15 | | | | |
| OVR718O | 0.80 | | | | |
| OVRA1B | 1.90 | | | | |

-continued

| Sample ID | CAN | NAT | NRM | BPH | PROST |
|---|---|---|---|---|---|
| OVR247A | | | 0.00 | | |
| OVR35GA | | | 0.03 | | |
| OVRC087 | | | 0.06 | | |
| OVRC109 | | | 0.04 | | |
| OVR206I | | | 0.00 | | |
| OVR515O | | | 0.00 | | |
| OVR18GA | | | 0.12 | | |
| OVR337O | | | 0.00 | | |
| OVR123O | | | 0.00 | | |
| OVRC177 | | | 0.03 | | |
| OVR40G | | | 0.02 | | |
| OVRC004 | | | 0.00 | | |
| BLD030B | 0.00 | 0.00 | | | |
| BLD520B | 0.74 | 0.02 | | | |
| BLDTR17 | 0.00 | 0.11 | | | |
| CLN401C | 0.40 | 0.35 | | | |
| CLNAS43 | 1.05 | 0.16 | | | |
| CLNAS98 | 0.16 | 0.25 | | | |
| CLNCM12 | 0.21 | 0.31 | | | |
| CLNDC19 | 0.47 | 0.17 | | | |
| CLNRC01 | 0.31 | 0.31 | | | |
| CLNRS53 | 0.18 | 1.03 | | | |
| CLNSG27 | 0.00 | 0.29 | | | |
| CLNTX01 | 0.36 | 0.25 | | | |
| CVXKS52 | 0.00 | 0.74 | | | |
| CVXNK23 | 0.68 | 2.29 | | | |
| CVXNKS54 | 1.18 | 2.21 | | | |
| CVXNKS55 | 0.92 | 0.82 | | | |
| CVXNKS81 | 1.72 | | | | |
| ENDO10479 | 0.48 | 1.16 | | | |
| ENDO28XA | 1.17 | 0.25 | | | |
| ENDO8XA | 0.52 | 0.13 | | | |
| KID106XD | 0.05 | 0.05 | | | |
| KID107XD | 0.00 | 0.21 | | | |
| KID109XD | 0.14 | 0.61 | | | |
| KID10XD | 0.00 | 0.06 | | | |
| KID22K | 0.21 | 0.10 | | | |
| LNG205L | 0.23 | 0.00 | | | |
| LNG315L | 0.15 | 2.19 | | | |
| LNG507L | 0.37 | 0.82 | | | |
| LNG528L | 2.95 | 0.60 | | | |
| LNG8837L | 0.45 | 0.70 | | | |
| LNGAC11 | 0.17 | 0.54 | | | |
| LNGAC39 | 1.86 | 0.23 | | | |
| LNGSQ80 | 0.82 | 0.00 | | | |
| LNGSQ81 | 1.06 | 0.69 | | | |
| LVR174L | 0.00 | 0.00 | | | |
| LVR187L | 0.00 | 0.29 | | | |
| MAM19DN | 1.16 | 0.87 | | | |
| MAM42DN | 0.60 | 0.00 | | | |
| MAM517 | 7.70 | 0.00 | | | |
| MAM781M | 0.41 | 0.74 | | | |
| MAM869M | 0.58 | 0.00 | | | |
| MAM976M | 1.01 | 0.42 | | | |
| MAMS570 | 2.29 | 4.07 | | | |
| MAMS699 | 0.39 | 0.00 | | | |
| MAMS997 | 1.33 | 0.86 | | | |
| PAN71XL | 0.44 | 0.77 | | | |
| PAN82XP | 0.10 | 7.85 | | | |
| PAN92X | 0.49 | 0.81 | | | |
| PRO23B | 0.15 | 0.19 | | | |
| PRO65XB | 0.20 | 0.52 | | | |
| PRO675P | 0.43 | 0.32 | | | |
| PRO84XB | 0.43 | 0.45 | | | |
| PRO958P | 0.46 | 0.52 | | | |
| PRO263C | | | | 0.00 | |
| PRO276P | | | | 0.13 | |
| PRO767B | | | | 0.48 | |
| PRO855P | | | | 0.28 | |
| PRO10R | | | | | 0.34 |
| PRO20R | | | | | 0.95 |
| SKN287S | 0.49 | 0.46 | | | |
| SKN39A | 0.00 | 0.16 | | | |
| SKN669S | 0.38 | 2.09 | | | |
| SMINT171S | 0.70 | 0.51 | | | |
| SMINT20SM | 0.83 | 0.31 | | | |
| SMINTH89 | 0.43 | 1.27 | | | |
| STO261S | 1.61 | 0.52 | | | |
| STO288S | 0.39 | 0.16 | | | |
| STO88S | 0.00 | 0.18 | | | |
| THRD143N | 0.25 | 0.45 | | | |
| THRD270T | 0.95 | 2.10 | | | |
| THRD56T | 2.62 | 0.23 | | | |
| TST39X | 0.47 | 0.90 | | | |
| TST647T | 0.38 | 0.16 | | | |
| TST663T | 0.30 | 0.02 | | | |
| UTR135XO | 0.09 | 0.30 | | | |
| UTR85XU | 1.07 | 0.59 | | | |
| BLOB1 | | | 0.00 | | |
| BLOB6 | | | 0.00 | | |
| BLOB11 | | | 0.95 | | |
| BLO982B | | | 0.00 | | |
| ADR48AD | | | 0.00 | | |
| BRN10BR | | | 0.00 | | |
| CLN01CL | | | 0.04 | | |
| CVX1ACV | | | 7.20 | | |
| ESO01ES | | | 0.56 | | |
| HRT46HR | | | 0.00 | | |
| HUMREF00HR | 0.00 | | | | |
| KID55KD | | | 0.01 | | |
| LVR89LV | | | 0.00 | | |
| LNG90LN | | | 0.26 | | |
| MAM01MA | | | 0.10 | | |
| MSL84MU | | | 0.00 | | |
| OVR3APV | | | 0.03 | | |
| PAN04PA | | | 0.11 | | |
| PLA59PL | | | 0.33 | | |
| PRO09PR | | | 0.27 | | |
| REC21RC | | | 0.18 | | |
| SMINT59SM | | | 0.09 | | |
| SPL7GSP | | | 0.06 | | |
| STO09ST | | | 0.21 | | |
| THYM99TM | | | 0.00 | | |
| TRA16TR | | | 0.69 | | |
| TST4GTS | | | 0.00 | | |
| UTR57UT | | | 0.14 | | |

0.00 = Negative or Not Detected

The sensitivity for Ovr223 expression was calculated for the cancer samples versus normal samples. The sensitivity value indicates the percentage of cancer samples that show levels of Ovr223 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr223 being useful as an ovarian cancer diagnostic marker and/or therapeutic target.

Sensitivity and specificity data is reported in the table below.

|  | CLN | LNG | MAM | OVR | PRO |
|---|---|---|---|---|---|
| Sensitivity, Up vs. NAT | 22% | 44% | 56% | 0% | 0% |
| Sensitivity, Down vs. NAT | 22% | 33% | 0% | 0% | 20% |
| Sensitivity, Up vs. NRM | 89% | 44% | 100% | 85% | 0% |
| Sensitivity, Down vs. NRM | 11% | 0% | 0% | 8% | 0% |
| Specificity | 24.32% | 25.41% | 30.81% | 22.86% | 25.67% |

Altogether, the tissue specificity, plus the mRNA differential expression in the samples tested are believed to make Ovr223 a good marker for diagnosing, monitoring, staging, imaging and/or treating ovarian cancer.

Additionally, the tissue specificity, plus the mRNA differential expression in the samples tested may make Ovr223 a good marker for diagnosing, monitoring, staging, imaging and/or treating breast cancer.

Primers used for QPCR Expression Analysis of Ovr223 are as follows:

(Ovr223_forward):   AGTGAGAGGGTGGGCATGTATG   (SEQ ID NO: 302)

(Ovr223_reverse):   TACTCCAGGCGCTCTGAGGAT   (SEQ ID NO: 303)

(Ovr223_probe):     TTAGCCAGTGGCCTCCACTCTGTCCC   (SEQ ID NO: 304)

DEX0455_034.nt.4 (Ovr223v2)

The relative expression level of Ovr223v2 in various tissue samples is included below. Tissue samples include 74 pairs of matching samples, 11 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 4 were blood samples which measured the expression levels in blood cells. Additionally, 2 prostatitis, and 4 Benign Prostatic Hyperplasia (BPH) samples are included. All the values are compared to normal pancreas sample PAN04PA (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.25 | 0.00 |  |  |  |
| OVRG010 | 4.93 |  |  |  |  |
| OVRG021 | 0.40 | 0.06 |  |  |  |
| OVR1157 | 3.69 |  |  |  |  |
| OVR773O | 7.06 |  |  |  |  |
| OVR988Z | 1.93 |  |  |  |  |
| OVRC360 | 0.34 |  |  |  |  |
| OVR1005O | 2.85 |  |  |  |  |
| OVR1040O | 3.20 |  |  |  |  |
| OVR105O | 3.02 |  |  |  |  |
| OVR130X | 1.84 |  |  |  |  |
| OVR718O | 2.15 |  |  |  |  |
| OVRA1B | 7.99 |  |  |  |  |
| OVR247A |  | 0.44 |  |  |  |

-continued

| Sample ID | CAN | NAT | NRM | BPH | PROST |
|---|---|---|---|---|---|
| OVR35GA |  |  | 0.21 |  |  |
| OVRC087 |  |  | 0.23 |  |  |
| OVRC109 |  |  | 0.20 |  |  |
| OVR206I |  |  | 0.11 |  |  |
| OVR515O |  |  | 0.12 |  |  |
| OVR18GA |  |  | 0.07 |  |  |
| OVR337O |  |  | 0.20 |  |  |
| OVR123O |  |  | 0.93 |  |  |
| OVRC177 |  |  | 0.10 |  |  |
| OVR40G |  |  | 0.05 |  |  |
| OVR451O |  |  | 0.32 |  |  |
| BLD030B | 0.20 | 1.10 |  |  |  |
| BLD520B | 2.00 | 0.18 |  |  |  |
| BLDTR17 | 0.39 | 1.04 |  |  |  |
| CLN401C | 0.85 | 1.23 |  |  |  |
| CLNAS43 | 2.68 | 0.16 |  |  |  |
| CLNAS98 | 0.61 | 0.35 |  |  |  |
| CLNCM12 | 0.61 | 0.80 |  |  |  |
| CLNDC19 | 1.94 | 1.18 |  |  |  |
| CLNRC01 | 0.46 | 0.42 |  |  |  |
| CLNRS53 | 0.54 | 1.26 |  |  |  |
| CLNSG27 | 0.61 | 0.65 |  |  |  |
| CLNTX01 | 1.62 | 0.59 |  |  |  |
| CVXKS52 | 3.54 | 4.98 |  |  |  |
| CVXNKS55 | 7.35 | 4.40 |  |  |  |
| CVXNKS25 | 4.23 | 4.81 |  |  |  |
| CVXNKS18 | 1.26 | 3.88 |  |  |  |
| CVXNKS54 | 3.00 | 1.47 |  |  |  |
| ENDO10479 | 3.07 | 0.37 |  |  |  |
| ENDO28XA | 4.24 | 0.69 |  |  |  |
| ENDO8XA | 0.31 | 3.57 |  |  |  |
| KID106XD | 0.11 | 0.33 |  |  |  |
| KID12XD | 0.27 | 2.13 |  |  |  |
| KID10XD | 0.10 | 0.21 |  |  |  |
| KID22K | 0.60 | 0.28 |  |  |  |
| KID107XD | 0.16 | 0.44 |  |  |  |
| LNG205L | 0.81 | 1.09 |  |  |  |
| LNG315L | 0.89 | 2.02 |  |  |  |
| LNG507L | 1.16 | 1.68 |  |  |  |
| LNG528L | 9.15 | 1.43 |  |  |  |
| LNG8837L | 1.46 | 1.65 |  |  |  |
| LNGAC11 | 0.86 | 1.78 |  |  |  |
| LNGAC39 | 6.93 | 1.66 |  |  |  |
| LNGSQ80 | 1.13 | 0.32 |  |  |  |
| LNGSQ81 | 1.95 | 1.13 |  |  |  |
| LVR15XA | 0.01 | 0.03 |  |  |  |
| LVR174L | 0.00 | 0.01 |  |  |  |
| LVR187L | 0.00 | 2.35 |  |  |  |
| MAM19DN | 3.52 | 3.45 |  |  |  |
| MAM42DN | 0.83 | 1.62 |  |  |  |
| MAM517 | 10.39 | 3.02 |  |  |  |
| MAM781M | 1.80 | 0.34 |  |  |  |
| MAM869M | 1.85 | 0.13 |  |  |  |
| MAM976M | 4.08 | 0.67 |  |  |  |
| MAMS570 | 2.43 | 4.41 |  |  |  |
| MAMS699 | 1.16 | 1.50 |  |  |  |
| MAMS997 | 1.20 | 1.39 |  |  |  |
| PAN71XL | 1.91 | 1.83 |  |  |  |
| PAN77X | 0.00 | 0.02 |  |  |  |
| PAN92X | 3.25 | 0.25 |  |  |  |
| PRO10R |  |  |  |  | 2.41 |
| PRO20R |  |  |  |  | 1.07 |
| PRO23B | 1.32 | 1.17 |  |  |  |
| PRO263C |  |  |  | 1.30 |  |
| PRO276P |  |  |  | 0.88 |  |

-continued

| Sample ID | CAN | NAT | NRM | BPH | PROST |
|---|---|---|---|---|---|
| PRO65XB | 0.87 | 1.60 | | | |
| PRO675P | 1.50 | 0.69 | | | |
| PRO767B | | | | 4.10 | |
| PRO84XB | 1.41 | 1.13 | | | |
| PRO855P | | | | | 1.16 |

-continued

| Sample ID | CAN | NAT | NRM | BPH | PROST |
|---|---|---|---|---|---|
| PRO958P | 2.49 | 2.56 | | | |
| SKN287S | 0.76 | 0.57 | | | |
| SKN39A | 0.25 | 0.20 | | | |
| SKN669S | 0.60 | 1.12 | | | |
| SMINT171S | 1.06 | 2.38 | | | |
| SMINT20SM | 3.20 | 1.14 | | | |
| SMINTH89 | 1.92 | 1.80 | | | |
| STO261S | 3.86 | 0.75 | | | |
| STO288S | 1.00 | 0.23 | | | |
| STOAC93 | 0.66 | 2.01 | | | |
| STO88S | 2.57 | 0.20 | | | |
| THRD143N | 1.77 | 1.15 | | | |
| THRD270T | 2.23 | 2.56 | | | |
| THRD56T | 3.02 | 0.40 | | | |
| TST39X | 0.80 | 0.77 | | | |
| TST647T | 1.15 | 0.43 | | | |
| TST663T | 0.55 | 0.05 | | | |
| UTR135XO | 0.58 | 0.52 | | | |
| UTR85XU | 2.70 | 1.49 | | | |
| BLOB3 | | | 0.19 | | |
| BLOB11 | | | 0.93 | | |
| BLO69 | | | 0.10 | | |
| BLO72 | | | 0.06 | | |
| BLO73 | | | 0.13 | | |
| ADR48AD | | | 0.15 | | |
| BRN10BR | | | 0.00 | | |
| CLN01CL | | | 1.03 | | |
| CVX06CV | | | 0.48 | | |
| ESO01ES | | | 3.34 | | |
| HRT46HR | | | 0.01 | | |
| HUMREF00HR | 0.08 | | | | |
| KID55KD | | | 0.27 | | |
| LVR89LV | | | 0.03 | | |
| LNG90LN | | | 3.99 | | |
| MAM01MA | | | 2.38 | | |
| MSL84MU | | | 0.00 | | |
| OVR3APV | | | 0.13 | | |
| PAN04PA | | | 1.00 | | |
| PRO09PR | | | 3.27 | | |
| REC21RC | | | 2.01 | | |
| SMINT59SM | | | 0.55 | | |
| SPL7GSP | | | 0.46 | | |
| STO09ST | | | 0.98 | | |
| THYM99TM | | | 0.54 | | |
| TRA16TR | | | 3.04 | | |
| TST4GTS | | | 0.10 | | |
| UTR57UT | | | 0.43 | | |

0.00 = Negative or Not Detected

The sensitivity for Ovr223v2 expression was calculated for the cancer samples versus normal samples. The sensitivity value indicates the percentage of cancer samples that show levels of Ovr223v2 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr223v2 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 33% | 44% | 0% | 20% |
| Sensitivity, Down vs. NAT | 11% | 22% | 0% | 0% | 0% |
| Sensitivity, Up vs. NRM | 11% | 11% | 11% | 85% | 0% |
| Sensitivity, Down vs. NRM | 11% | 78% | 22% | 0% | 80% |
| Specificity | 8.06% | 12.9% | 16.67% | 19.77% | 14.89% |

Altogether, the tissue specificity, plus the mRNA differential expression in the samples tested are believed to make Ovr223v2 a good marker for diagnosing, monitoring, staging, imaging and/or treating ovarian cancer.

Primers used for QPCR Expression Analysis of Ovr223v2 are as follows:

```
                                            (SEQ ID NO: 305)
(Ovr223v2_forward):  TCCAGATGGCTCAGCTTCTTC (SEQ ID NO: 306)
(Ovr223v2_reverse):  GAAGGTGTTCGGAGAATGAGTGA (SEQ ID NO: 307)
(Ovr223v2_probe):    TTTCTTCTGTGGCTCTGTGTTTTCCAGGC
```

DEX0455_037.nt.6 (Ovr229)

The relative expression level of Ovr229 in various tissue samples is included below. Tissue samples include 74 pairs of matching samples, 10 non matched cancer samples, and 40 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to normal prostate sample PRO09PR (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.01 | 0.00 | | | |
| OVRG010 | 0.36 | 0.00 | | | |
| OVRG021 | 0.39 | 0.09 | | | |
| OVR1157 | 0.00 | | | | |
| OVR773O | 0.31 | | | | |
| OVR988Z | 1.25 | | | | |
| OVRC360 | 1.64 | | | | |
| OVR1005O | 0.47 | | | | |
| OVR1040O | 1.49 | | | | |
| OVR105O | 0.33 | | | | |

-continued

| Sample ID | CAN | NAT | NRM | BPH | PROST |
|---|---|---|---|---|---|
| OVR130X | 0.00 | | | | |
| OVR718O | 0.42 | | | | |
| OVRA1B | 0.27 | | | | |
| OVR247A | | | 0.00 | | |
| OVR35GA | | | 0.05 | | |
| OVRC087 | | | 0.40 | | |
| OVRC109 | | | 0.00 | | |
| OVR206I | | | 0.12 | | |
| OVR515O | | | 0.42 | | |
| OVR18GA | | | 0.00 | | |
| OVR337O | | | 0.00 | | |
| OVR123O | | | 0.00 | | |
| OVRC177 | | | 0.22 | | |
| OVR40G | | | 0.00 | | |
| OVR451O | | | 0.00 | | |
| BLD030B | 0.04 | 0.14 | | | |
| BLD520B | 0.00 | 0.23 | | | |
| BLDTR17 | 0.37 | 0.19 | | | |
| CLN401C | 0.04 | 0.04 | | | |
| CLNAS43 | 0.10 | 0.14 | | | |
| CLNAS98 | 0.00 | 0.00 | | | |
| CLNCM12 | 0.11 | 0.12 | | | |
| CLNDC19 | 0.00 | 0.09 | | | |
| CLNRC01 | 0.01 | 0.02 | | | |
| CLNRS53 | 0.00 | 0.00 | | | |
| CLNSG27 | 0.08 | 0.31 | | | |
| CLNTX01 | 0.00 | 0.24 | | | |
| CVXKS52 | 0.00 | 0.35 | | | |
| CVXNKS55 | 0.03 | 0.25 | | | |
| CVXNKS25 | 1.68 | 0.25 | | | |
| CVXNKS18 | 0.00 | 0.06 | | | |
| CVXNKS54 | 0.00 | 1.22 | | | |
| ENDO10479 | 0.13 | 0.35 | | | |
| ENDO28XA | 0.18 | 0.54 | | | |
| ENDO8XA | 0.00 | 0.05 | | | |
| KID106XD | 0.00 | 0.02 | | | |
| KID12XD | 0.01 | 0.37 | | | |
| KID10XD | 0.00 | 0.01 | | | |
| KID22K | 0.02 | 0.06 | | | |
| KID107XD | 0.00 | 0.02 | | | |
| LNG205L | 0.01 | 1.04 | | | |
| LNG315L | 0.14 | 1.69 | | | |
| LNG507L | 0.48 | 3.36 | | | |
| LNG528L | 0.00 | 0.71 | | | |
| LNG8837L | 0.12 | 1.08 | | | |
| LNGAC11 | 0.10 | 0.20 | | | |
| LNGAC39 | 0.52 | 2.65 | | | |
| LNGSQ80 | 0.16 | 2.29 | | | |
| LNGSQ81 | 0.23 | 2.01 | | | |
| LVR15XA | 0.00 | 0.03 | | | |
| LVR174L | 0.00 | 0.02 | | | |
| LVR187L | 0.00 | 0.00 | | | |
| MAM19DN | 0.00 | 0.28 | | | |
| MAM42DN | 0.17 | 0.00 | | | |
| MAM517 | 2.59 | 0.00 | | | |
| MAM781M | 0.00 | 0.00 | | | |
| MAM869M | 0.05 | 0.74 | | | |
| MAM976M | 0.26 | 0.00 | | | |
| MAMS570 | 0.00 | 0.00 | | | |
| MAMS699 | 0.28 | 0.89 | | | |
| MAMS997 | 0.13 | 0.23 | | | |
| PAN71XL | 0.06 | 0.09 | | | |
| PAN77X | 0.00 | 0.05 | | | |
| PAN92X | 0.27 | 0.00 | | | |
| PRO10R | | | | | 1.00 |
| PRO20R | | | | | 8.84 |
| PRO23B | 1.11 | 1.14 | | | |
| PRO263C | | | | | 1.16 |
| PRO276P | | | | | 0.93 |
| PRO65XB | 0.14 | 0.85 | | | |
| PRO675P | 0.42 | 0.51 | | | |
| PRO767B | | | | | 0.88 |
| PRO84XB | 0.15 | 3.51 | | | |
| PRO855P | | | | | 2.76 |
| PRO958P | 0.76 | 2.69 | | | |
| SKN287S | 0.22 | 2.01 | | | |
| SKN39A | 0.16 | 0.00 | | | |
| SKN669S | 0.40 | 0.00 | | | |
| SMINT171S | 0.02 | 0.04 | | | |
| SMINT20SM | 0.07 | 0.15 | | | |
| SMINTH89 | 0.05 | 0.00 | | | |
| STO261S | 0.00 | 0.11 | | | |
| STO288S | 0.02 | 0.12 | | | |
| STOAC93 | 0.23 | 0.05 | | | |
| THRD143N | 0.00 | 0.27 | | | |
| THRD270T | 0.09 | 0.07 | | | |
| THRD56T | 0.00 | 0.00 | | | |
| TST39X | 0.00 | 8.21 | | | |
| TST647T | 0.19 | 9.27 | | | |
| TST663T | 0.14 | 10.16 | | | |
| UTR135XO | 0.58 | 0.35 | | | |
| UTR85XU | 0.00 | 0.99 | | | |
| BLOB3 | | | 0.00 | | |
| BLOB11 | | | 0.00 | | |
| BLO69 | | | 0.00 | | |
| BLO72 | | | 0.17 | | |
| BLO73 | | | 0.00 | | |
| ADR48AD | | | 0.00 | | |
| BRN10BR | | | 2.25 | | |
| CLN01CL | | | 0.10 | | |
| CVX06CV | | | 2.46 | | |
| ESO01ES | | | 0.00 | | |
| HRT46HR | | | 0.88 | | |
| HUMREF00HR | 0.00 | | | | |
| KID55KD | | | 0.02 | | |
| LVR89LV | | | 0.03 | | |
| LNG90LN | | | 0.03 | | |
| MAM01MA | | | 0.02 | | |
| MSL84MU | | | 0.02 | | |
| OVR3APV | | | 0.08 | | |
| PAN04PA | | | 0.29 | | |
| PLA59PL | | | 1.46 | | |
| PRO09PR | | | 1.00 | | |
| REC21RC | | | 0.67 | | |
| SMINT59SM | | | 0.04 | | |
| SPL7GSP | | | 0.80 | | |
| STO09ST | | | 0.10 | | |
| THYM99TM | | | 0.46 | | |
| TRA16TR | | | 0.15 | | |
| TST4GTS | | | 12.18 | | |
| UTR57UT | | | 1.54 | | |

0.00 = Negative or Not Detected

The sensitivity for Ovr229 expression was calculated for the cancer samples versus normal samples. The sensitivity value indicates the percentage of cancer samples that show levels of Ovr229 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr229 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 0% | 0% | 33% | 0% | 0% |
| Sensitivity, Down vs. NAT | 44% | 100% | 33% | 0% | 60% |
| Sensitivity, Up vs. NRM | 0% | 78% | 67% | 85% | 0% |
| Sensitivity, Down vs. NRM | 67% | 22% | 33% | 0% | 60% |
| Specificity | 26.06% | 31.38% | 28.19% | 35.96% | 42.11% |

Altogether, the tissue specificity, plus the mRNA differential expression in the samples tested are believed to make Ovr229 a good marker for diagnosing, monitoring, staging, imaging and/or treating ovarian cancer.

Primers used for QPCR Expression Analysis of Ovr229 are as follows:

(Ovr229_forward):    CCTGCCGCGGAGATCCAT (SEQ ID NO: 308)

(Ovr229_reverse):    GCAGCGCGTACTGGTCGTA (SEQ ID NO: 309)

(Ovr229_probe):    CCTACTCCGTGTCAGTGGTGGAG (SEQ ID NO: 310)

DEX0455_037.nt.7 (Ovr227)

The relative expression level of Ovr227 in various tissue samples is included below. Tissue samples include 74 pairs of matching samples, 10 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to prostate normal sample PRO09PR (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 1.31 | 0.24 | | | |
| OVRG010 | 1.65 | 0.75 | | | |
| OVRG021 | 0.87 | 0.00 | | | |
| OVR1157 | 0.85 | | | | |
| OVR773O | 0.21 | | | | |
| OVR814O | 0.24 | | | | |
| OVRC360 | 0.58 | | | | |
| OVR1005O | 0.33 | | | | |
| OVR1040O | 0.11 | | | | |
| OVR105O | 0.12 | | | | |
| OVR130X | 0.15 | | | | |
| OVR718O | 0.32 | | | | |
| OVRA1B | 0.11 | | | | |
| OVR247A | | | 0.40 | | |
| OVR35GA | | | 0.06 | | |
| OVRC087 | | | 0.16 | | |
| OVRC109 | | | 0.08 | | |
| OVR206I | | | 0.00 | | |
| OVR515O | | | 0.63 | | |
| OVR18GA | | | 0.00 | | |
| OVR337O | | | 0.00 | | |
| OVR123O | | | 0.00 | | |
| OVRC177 | | | 0.03 | | |
| OVR40G | | | 0.02 | | |
| OVRC004 | | | 0.00 | | |
| BLD030B | 0.02 | 0.00 | | | |
| BLD520B | 0.00 | 0.06 | | | |
| BLDTR17 | 0.00 | 0.00 | | | |
| CLN401C | 0.02 | 0.04 | | | |
| CLNAS43 | 0.00 | 0.00 | | | |
| CLNAS98 | 0.00 | 0.09 | | | |
| CLNCM12 | 0.06 | 0.05 | | | |
| CLNDC19 | 0.04 | 0.10 | | | |
| CLNRC01 | 0.00 | 0.00 | | | |
| CLNRS53 | 0.18 | 0.40 | | | |
| CLNSG27 | 0.00 | 0.28 | | | |
| CLNTX01 | 0.58 | 0.00 | | | |
| CVXKS52 | 0.00 | 0.49 | | | |
| CVXNK23 | 0.00 | 0.00 | | | |
| CVXNKS54 | 1.12 | 2.58 | | | |
| CVXNKS55 | 0.01 | 0.00 | | | |
| CVXNKS81 | 0.00 | 0.00 | | | |
| ENDO10479 | 0.00 | 2.93 | | | |
| ENDO28XA | 0.76 | 0.52 | | | |
| ENDO8XA | 0.03 | 0.00 | | | |
| KID106XD | 0.00 | 0.00 | | | |
| KID107XD | 0.00 | 0.04 | | | |
| KID109XD | 0.00 | 0.00 | | | |
| KID10XD | 0.21 | 0.02 | | | |
| KID22K | 0.01 | 0.02 | | | |
| LNG205L | 0.00 | 0.35 | | | |
| LNG315L | 0.33 | 1.50 | | | |
| LNG507L | 0.24 | 2.81 | | | |
| LNG528L | 0.00 | 0.42 | | | |
| LNG8837L | 0.18 | 1.12 | | | |
| LNGAC11 | 0.20 | 0.04 | | | |
| LNGAC39 | 0.59 | 1.37 | | | |
| LNGSQ80 | 1.38 | 1.09 | | | |
| LNGSQ81 | 0.65 | 1.59 | | | |
| LVR15XA | 0.00 | 0.02 | | | |
| LVR174L | 0.00 | 0.01 | | | |
| LVR187L | 0.00 | 0.09 | | | |
| MAM19DN | 0.00 | 0.07 | | | |
| MAM42DN | 0.16 | 0.00 | | | |
| MAM517 | 0.00 | 0.00 | | | |
| MAM781M | 0.00 | 0.24 | | | |
| MAM869M | 0.00 | 0.00 | | | |
| MAM976M | 0.12 | 0.00 | | | |
| MAMS570 | 0.00 | 0.00 | | | |
| MAMS699 | 0.53 | 0.00 | | | |
| MAMS997 | 0.20 | 0.11 | | | |
| PAN71XL | 0.00 | 0.03 | | | |
| PAN82XP | 0.00 | 0.00 | | | |
| PAN92X | 0.10 | 0.78 | | | |
| PRO23B | 0.35 | 0.20 | | | |
| PRO65XB | 0.05 | 0.61 | | | |
| PRO675P | 0.22 | 0.40 | | | |
| PRO84XB | 0.12 | 1.68 | | | |
| PRO958P | 0.18 | 0.31 | | | |
| PRO263C | | | | 0.32 | |
| PRO276P | | | | 0.21 | |
| PRO767B | | | | 0.69 | |
| PRO855P | | | | 0.29 | |
| PRO10R | | | | | 0.38 |
| PRO20R | | | | | 1.35 |
| SKN287S | 0.00 | 2.19 | | | |
| SKN39A | 0.17 | 0.00 | | | |
| SKN669S | 0.14 | 0.12 | | | |
| SMINT171S | 0.39 | 0.15 | | | |
| SMINT20SM | 0.06 | 0.07 | | | |
| SMINTH89 | 0.01 | 0.00 | | | |
| STO261S | 0.60 | 0.18 | | | |
| STO288S | 0.03 | 0.04 | | | |
| STO88S | 0.00 | 0.07 | | | |
| THRD143N | 0.01 | 0.04 | | | |
| THRD270T | 0.03 | 0.03 | | | |
| THRD56T | 0.00 | 0.14 | | | |
| TST39X | 0.00 | 1.74 | | | |
| TST647T | 0.02 | 3.30 | | | |
| TST663T | 0.05 | 0.68 | | | |
| UTR135XO | 0.22 | 0.17 | | | |
| UTR85XU | 0.12 | 0.19 | | | |
| BLOB1 | | | 7.89 | | |
| BLOB3 | | | 0.00 | | |
| BLOB6 | | | 0.00 | | |
| BLOB11 | | | 0.07 | | |
| BLO982B | | | 2.25 | | |
| ADR48AD | | | 0.00 | | |
| BRN10BR | | | 1.02 | | |
| CLN01CL | | | 0.00 | | |
| ESO01ES | | | 0.25 | | |
| HRT46HR | | | 0.10 | | |

| Sample ID | CAN | NAT | NRM | BPH | PROST |
|---|---|---|---|---|---|
| HUMREF00HR | 0.00 | | | | |
| KID55KD | | | 0.01 | | |
| LVR89LV | | | 0.02 | | |
| LNG90LN | | | 0.11 | | |
| MAM01MA | | | 0.00 | | |
| MSL84MU | | | 0.07 | | |
| OVR3APV | | | 0.02 | | |
| PAN04PA | | | 0.20 | | |
| PLA59PL | | | 0.42 | | |
| PRO09PR | | | 1.00 | | |
| REC21RC | | | 0.28 | | |
| SMINT59SM | | | 0.01 | | |
| SPL7GSP | | | 1.33 | | |
| STO09ST | | | 0.02 | | |
| THYM99TM | | | 0.38 | | |
| TRA16TR | | | 0.10 | | |
| TST4GTS | | | 2.47 | | |
| UTR57UT | | | 0.43 | | |

0.00 = Negative or Not Detected

The sensitivity for Ovr227 expression was calculated for the cancer samples versus normal samples. The sensitivity value indicates the percentage of cancer samples that show levels of Ovr227 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr227 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 11% | 11% | 33% | 0% | 0% |
| Sensitivity, Down vs. NAT | 67% | 78% | 22% | 0% | 40% |
| Sensitivity, Up vs. NRM | 56% | 56% | 44% | 100% | 0% |
| Sensitivity, Down vs. NRM | 0% | 22% | 0% | 0% | 100% |
| Specificity | 28.11% | 40.54% | 25.41% | 42.86% | 39.04% |

Altogether, the tissue specificity, plus the mRNA differential expression in the samples tested are believed to make Ovr227 a good marker for diagnosing, monitoring, staging, imaging and/or treating ovarian cancer.

Primers used for QPCR Expression Analysis of Ovr227 are as follows:

```
(Ovr227_forward):    AGAGGCGCCCCCGCAGGTA        (SEQ ID NO: 311)

(Ovr227_reverse):    CCCGGAGCCAGCTCGAGTT        (SEQ ID NO: 312)

(Ovr227_probe):      CAGGAACTGCGGCGAGCGACCC     (SEQ ID NO: 313)
```

DEX0455_040.nt.2 (Ovr218)

The relative expression level of Ovr218 in various tissue samples is included below. Tissue samples include 75 pairs of matching samples, 10 non matched cancer samples, and 41 normal samples, all from various tissues annotated in the table. A matching pair is formed by mRNA from the cancer sample for a particular tissue and mRNA from the normal adjacent sample for that same tissue from the same individual. Of the normal samples 6 were blood samples which measured the expression levels in blood cells. Additionally, 2 prostatitis, and 4 Benign Prostatic Hyperplasia (BPH) samples are included. All the values are compared to cancer pool reference HUMREF00HR (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.46 | 0.17 | | | |
| OVRG010 | 1.55 | 3.95 | | | |
| OVRG021 | 6.74 | 6.08 | | | |
| OVR1157 | 4.90 | | | | |
| OVR7730 | 8.80 | | | | |
| OVR8140 | 3.90 | | | | |
| OVRC360 | 1.37 | | | | |
| OVR1005O | 19.92 | | | | |
| OVR1040O | 20.35 | | | | |
| OVR105O | 5.63 | | | | |
| OVR130X | 19.60 | | | | |
| OVR718O | 55.03 | | | | |
| OVRA1B | 34.34 | | | | |
| OVR247A | | | 1.35 | | |
| OVR35GA | | | 2.50 | | |
| OVRC087 | | | 0.98 | | |
| OVRC109 | | | 0.23 | | |
| OVR206I | | | 3.37 | | |
| OVR515O | | | 1.42 | | |
| OVR18GA | | | 1.49 | | |
| OVR337O | | | 3.54 | | |
| OVR123O | | | 3.29 | | |
| OVRC177 | | | 3.49 | | |
| OVR40G | | | 1.62 | | |
| OVRC004 | | | 9.36 | | |
| BLD030B | 3.36 | 0.72 | | | |
| BLD520B | 3.23 | 2.25 | | | |
| BLDTR17 | 1.08 | 1.89 | | | |
| CLN401C | 3.90 | 3.01 | | | |
| CLNAS43 | 4.55 | 1.92 | | | |
| CLNAS98 | 3.44 | 2.33 | | | |
| CLNCM12 | 3.07 | 3.22 | | | |
| CLNDC19 | 7.72 | 2.05 | | | |
| CLNRC01 | 1.80 | 2.17 | | | |
| CLNRS53 | 2.59 | 3.02 | | | |
| CLNSG27 | 2.69 | 4.49 | | | |
| CLNTX01 | 5.68 | 5.10 | | | |
| CVXKS52 | 9.10 | 10.59 | | | |
| CVXNK23 | 9.81 | 41.11 | | | |
| CVXNKS54 | 20.97 | 12.22 | | | |
| CVXNKS55 | 37.01 | 21.89 | | | |
| CVXNKS81 | 17.75 | 35.18 | | | |
| ENDO10479 | 13.27 | 1.33 | | | |
| ENDO28XA | 13.53 | 4.98 | | | |
| ENDO8XA | 0.34 | 0.58 | | | |
| KID106XD | 0.28 | 0.70 | | | |
| KID107XD | 5.01 | 2.27 | | | |
| KID109XD | 7.16 | 4.83 | | | |
| KID10XD | 1.34 | 0.46 | | | |
| KID22K | 2.79 | 0.65 | | | |
| LNG205L | 1.40 | 4.10 | | | |
| LNG315L | 8.68 | 8.32 | | | |
| LNG507L | 6.50 | 4.85 | | | |
| LNG528L | 9.26 | 4.03 | | | |
| LNG8837L | 4.36 | 5.37 | | | |
| LNGAC11 | 2.50 | 4.70 | | | |
| LNGAC39 | 16.03 | 4.63 | | | |
| LNGSQ80 | 3.70 | 0.84 | | | |
| LNGSQ81 | 14.10 | 7.33 | | | |

259

-continued

| Sample ID | CAN | NAT | NRM | BPH | PROST |
|---|---|---|---|---|---|
| LVR15XA | 0.05 | 0.03 | | | |
| LVR174L | 0.15 | 0.12 | | | |
| LVR187L | 0.00 | 9.89 | | | |
| MAM19DN | 17.32 | 17.15 | | | |
| MAM42DN | 15.00 | 9.52 | | | |
| MAM517 | 66.52 | 6.34 | | | |
| MAM781M | 4.45 | 3.02 | | | |
| MAM869M | 9.21 | 1.73 | | | |
| MAM976M | 28.64 | 3.82 | | | |
| MAMS570 | 22.00 | 25.62 | | | |
| MAMS699 | 5.42 | 5.54 | | | |
| MAMS997 | 10.63 | 7.95 | | | |
| PAN71XL | 5.56 | 5.74 | | | |
| PAN82XP | 2.41 | 26.35 | | | |
| PAN92X | 52.91 | 6.82 | | | |
| PRO23B | 7.13 | 7.97 | | | |
| PRO65XB | 5.61 | 6.99 | | | |
| PRO675P | 7.00 | 4.30 | | | |
| PRO84XB | 7.18 | 6.80 | | | |
| PRO958P | 6.32 | 4.35 | | | |
| PRO263C | | | 6.28 | | |
| PRO276P | | | 4.78 | | |
| PRO767B | | | 10.75 | | |
| PRO855P | | | 5.51 | | |
| PRO10R | | | | 9.97 | |
| PRO20R | | | | 8.32 | |
| SKN287S | 6.30 | 6.42 | | | |
| SKN39A | 4.04 | 1.83 | | | |
| SKN669S | 6.16 | 19.67 | | | |
| SMINT171S | 11.57 | 8.96 | | | |
| SMINT20SM | 10.72 | 4.23 | | | |
| SMINTH89 | 5.77 | 4.77 | | | |
| STO261S | 8.85 | 2.39 | | | |
| STO288S | 2.33 | 1.18 | | | |
| STO509L | 5.78 | 10.86 | | | |
| STO88S | 4.07 | 1.01 | | | |
| THRD143N | 8.25 | 15.21 | | | |
| THRD270T | 10.97 | 7.35 | | | |
| THRD56T | 9.88 | 11.23 | | | |
| TST39X | 9.41 | 4.59 | | | |
| TST647T | 11.31 | 1.05 | | | |
| TST663T | 7.35 | 2.94 | | | |
| UTR135XO | 2.34 | 5.62 | | | |
| UTR85XU | 17.13 | 6.68 | | | |
| BLOB1 | | | 7.23 | | |
| BLOB3 | | | 3.50 | | |
| BLOB5 | | | 122.49 | | |
| BLOB6 | | | 9.34 | | |
| BLOB11 | | | 5.44 | | |
| BLO982B | | | 14.78 | | |
| ADR48AD | | | 0.61 | | |
| BRN10BR | | | 0.99 | | |
| CLN01CL | | | 0.51 | | |
| CVX1ACV | | | 14.89 | | |
| ESO01ES | | | 5.63 | | |
| HRT46HR | | | 0.00 | | |
| HUMREF00HR | 1.00 | | | | |
| KID55KD | | | 0.29 | | |
| LVR89LV | | | 0.05 | | |
| LNG90LN | | | 2.25 | | |
| MAM01MA | | | 1.00 | | |
| MSL84MU | | | 0.00 | | |
| OVR3APV | | | 0.93 | | |
| PAN04PA | | | 2.42 | | |
| PLA59PL | | | 3.63 | | |
| PRO09PR | | | 3.03 | | |
| REC21RC | | | 2.74 | | |
| SMINT59SM | | | 2.21 | | |
| SPL7GSP | | | 1.19 | | |
| STO09ST | | | 0.87 | | |
| THYM99TM | | | 5.68 | | |
| TRA16TR | | | 8.67 | | |
| TST4GTS | | | 9.06 | | |
| UTR57UT | | | 1.93 | | |

0.00 = Negative or Not Detected

The sensitivity for Ovr218 expression was calculated for the cancer samples versus normal samples. The sensitivity value indicates the percentage of cancer samples that show levels of Ovr218 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr218 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 33% | 33% | 0% | 0% |
| Sensitivity, Down vs. NAT | 0% | 11% | 0% | 0% | 0% |
| Sensitivity, Up vs. NRM | 100% | 56% | 100% | 77% | 80% |
| Sensitivity, Down vs. NRM | 0% | 0% | 0% | 8% | 0% |
| Specificity | 6.88% | 9.52% | 20.63% | 8.94% | 9.95% |

Altogether, the tissue specificity, plus the mRNA differential expression in the samples tested are believed to make Ovr218 a good marker for diagnosing, monitoring, staging, imaging and/or treating ovarian cancer.

Additionally, the tissue specificity, plus the mRNA differential expression in the samples tested may make Ovr218 a good marker for diagnosing, monitoring, staging, imaging and/or treating breast cancer.

Primers used for QPCR Expression Analysis of Ovr218 are as follows:

```
                                      (SEQ ID NO: 314)
(Ovr218_forward):   TGCCCAGCTGTGGTTTACATTA (SEQ ID NO: 315)
(Ovr218_reverse):   CACCACCTCGCCATTCTCA (SEQ ID NO: 316)
(Ovr218_probe):     TTCACTGTGAACATCATCTTGGCA
```

DEX0455__049.nt.1 (Ovr232)

The relative expression level of Ovr232 in various tissue samples is included below. Tissue samples include 73 pairs of matching samples, 10 non matched cancer samples, and 36 normal samples, all from various tissues annotated in the table. A matching pair is formed by mRNA from the cancer sample for a particular tissue and mRNA from the normal adjacent sample for that same tissue from the same individual. Of the normal samples 4 were blood samples which measured the expression levels in blood cells. Additionally, 2 prostatitis, and 4 Benign Prostatic Hyperplasia (BPH) samples are included. All the values are compared to ovarian cancer sample OVRAO84 (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 1.00 | 0.10 | | | |
| OVRG010 | 0.01 | 0.31 | | | |
| OVRG021 | 0.39 | 0.02 | | | |
| OVR1157 | 2.79 | | | | |
| OVR7773O | 1.14 | | | | |
| OVR814O | 0.37 | | | | |
| OVRC360 | 0.00 | | | | |
| OVR1005O | 5.91 | | | | |
| OVR1040O | 5.77 | | | | |
| OVR105O | 1.68 | | | | |
| OVR130X | 1.08 | | | | |
| OVR718O | 0.55 | | | | |
| OVRA1B | 4.48 | | | | |
| OVR247A | | | 0.00 | | |
| OVR35GA | | | 0.00 | | |
| OVRC087 | | | 0.00 | | |
| OVRC109 | | | 0.00 | | |
| OVR206I | | | 0.03 | | |
| OVR515O | | | 0.00 | | |
| OVR18GA | | | 0.00 | | |
| OVR123O | | | 0.00 | | |
| OVRC177 | | | 0.02 | | |
| OVR40G | | | 0.00 | | |
| OVRC004 | | | 0.00 | | |
| BLD030B | 0.26 | 0.00 | | | |
| BLD520B | 0.13 | 0.02 | | | |
| BLDTR17 | 0.24 | 0.25 | | | |
| CLN401C | 3.46 | 2.62 | | | |
| CLNAS43 | 4.08 | 1.49 | | | |
| CLNAS98 | 1.19 | 5.27 | | | |
| CLNCM12 | 2.46 | 7.45 | | | |
| CLNDC19 | 9.09 | 1.85 | | | |
| CLNRC01 | 2.55 | 3.52 | | | |
| CLNRS53 | 1.38 | 9.36 | | | |
| CLNSG27 | 4.28 | 3.65 | | | |
| CLNTX01 | 3.83 | 4.54 | | | |
| CVXKS52 | 0.15 | 0.12 | | | |
| CVXNK23 | 0.13 | 0.00 | | | |
| CVXNKS54 | 0.59 | 0.54 | | | |
| CVXNKS55 | 0.58 | 0.15 | | | |
| CVXNKS81 | 0.25 | 0.61 | | | |
| ENDO10479 | 6.19 | 1.01 | | | |
| ENDO28XA | 6.03 | 0.82 | | | |
| ENDO8XA | 0.40 | 1.67 | | | |
| KID106XD | 0.02 | 0.24 | | | |
| KID107XD | 0.10 | 0.34 | | | |
| KID109XD | 0.07 | 0.59 | | | |
| KID10XD | 0.00 | 0.15 | | | |
| KID22K | 0.05 | 0.14 | | | |
| LNG205L | 0.08 | 1.91 | | | |
| LNG315L | 1.42 | 0.43 | | | |
| LNG507L | 0.96 | 0.87 | | | |
| LNG528L | 9.39 | 0.92 | | | |
| LNG8837L | 1.08 | 0.45 | | | |
| LNGAC11 | 0.28 | 1.23 | | | |
| LNGAC39 | 13.19 | 0.76 | | | |
| LNGSQ80 | 2.02 | 0.86 | | | |
| LNGSQ81 | 2.19 | 0.67 | | | |
| LVR15XA | 0.00 | 0.01 | | | |
| LVR174L | 0.00 | 0.01 | | | |
| LVR187L | 0.00 | 10.06 | | | |
| MAM19DN | 0.46 | 0.85 | | | |
| MAM42DN | 0.71 | 0.74 | | | |
| MAM517 | 3.27 | 0.33 | | | |
| MAM781M | 1.52 | 0.34 | | | |
| MAM976M | 0.83 | 0.37 | | | |
| MAMS570 | 0.35 | 1.02 | | | |
| MAMS699 | 0.28 | 0.39 | | | |
| MAMS997 | 1.23 | 0.52 | | | |
| PAN71XL | 6.96 | 4.45 | | | |
| PAN82XP | 0.15 | 2.74 | | | |
| PAN92X | 2.89 | 0.00 | | | |
| PRO23B | 0.23 | 0.12 | | | |
| PRO65XB | 0.24 | 0.50 | | | |
| PRO675P | 0.40 | 0.21 | | | |
| PRO84XB | 0.45 | 0.30 | | | |
| PRO958P | 0.22 | 0.21 | | | |
| PRO263C | | | | 0.27 | |
| PRO276P | | | | 0.12 | |
| PRO767B | | | | 0.24 | |
| PRO855P | | | | 0.21 | |
| PRO10R | | | | | 0.18 |
| PRO20R | | | | | 0.44 |
| SKN287S | 0.38 | 0.11 | | | |
| SKN39A | 0.00 | 0.00 | | | |
| SKN669S | 0.03 | 0.08 | | | |
| SMINT171S | 3.18 | 4.30 | | | |
| SMINT20SM | 8.08 | 5.63 | | | |
| SMINTH89 | 8.24 | 3.50 | | | |
| STO261S | 6.10 | 2.42 | | | |
| STO288S | 5.52 | 0.23 | | | |
| STO88S | 2.64 | 0.14 | | | |
| THRD143N | 1.00 | 5.56 | | | |
| THRD270T | 8.64 | 11.30 | | | |
| THRD56T | 3.91 | 1.96 | | | |
| TST39X | 0.42 | 0.56 | | | |
| TST647T | 4.38 | 0.11 | | | |
| TST663T | 2.81 | 0.13 | | | |
| UTR135XO | 0.40 | 0.48 | | | |
| UTR85XU | 3.06 | 1.79 | | | |
| BLOB3 | | | 0.31 | | |
| BLOB6 | | | 0.00 | | |
| BLOB11 | | | 0.00 | | |
| BLO982B | | | 0.00 | | |
| ADR48AD | | | 0.00 | | |
| BRN10BR | | | 0.07 | | |
| CLN01CL | | | 0.57 | | |
| ESO01ES | | | 0.00 | | |
| HUMREF00HR | 0.17 | | | | |
| KID55KD | | | 0.05 | | |
| LVR89LV | | | 0.00 | | |
| LNG90LN | | | 2.56 | | |
| MAM01MA | | | 0.13 | | |
| MSL84MU | | | 0.00 | | |
| OVR3APV | | | 0.00 | | |
| PAN04PA | | | 0.09 | | |
| PLA59PL | | | 0.00 | | |
| PRO09PR | | | 0.30 | | |
| REC21RC | | | 4.27 | | |
| SMINT59SM | | | 0.97 | | |
| SPL7GSP | | | 0.03 | | |
| STO09ST | | | 0.09 | | |
| THYM99TM | | | 0.04 | | |
| TRA16TR | | | 0.43 | | |
| TST4GTS | | | 0.11 | | |
| UTR57UT | | | 0.07 | | |

0.00 = Negative or Not Detected

The sensitivity for Ovr232 expression was calculated for the cancer samples versus normal samples. The sensitivity value indicates the percentage of cancer samples that show levels of Ovr232 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr232 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 67% | 44% | 0% | 0% |
| Sensitivity, Down vs. NAT | 33% | 22% | 11% | 0% | 20% |

|  | CLN | LNG | MAM | OVR | PRO |
|---|---|---|---|---|---|
| Sensitivity, Up vs. NRM | 100% | 22% | 100% | 92% | 0% |
| Sensitivity, Down vs. NRM | 0% | 44% | 0% | 8% | 0% |
| Specificity | 50.82% | 33.88% | 22.95% | 21.84% | 19.46% |

Altogether, the tissue specificity, plus the mRNA differential expression in the samples tested are believed to make Ovr232 a good marker for diagnosing, monitoring, staging, imaging and/or treating ovarian cancer.

Primers used for QPCR Expression Analysis of Ovr232 are as follows:

```
(Ovr232_forward):
                                        (SEQ ID NO: 317)
GCTCAAAGCGTGAGTAAAATATCCT (Ovr232_reverse):
                                        (SEQ ID NO: 318)
CCACACTTACTTTGTAACATGATTCAGA (Ovr232_probe):
                                        (SEQ ID NO: 319)
TTTGACTTAATACTTCTTTAATTGATGTGCCTTGAGTTGG
```

DEX0455_049.nt.2 (Ovr232v1)

The relative expression level of Ovr232v1 in various tissue samples is included below. Tissue samples include 75 pairs of matching samples, 10 non matched cancer samples, and 40 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to normal colon sample CLN01CL (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.02 | 0.67 | | | |
| OVRG010 | 0.00 | 0.00 | | | |
| OVRG021 | 0.10 | 0.00 | | | |
| OVR1157 | 0.00 | | | | |
| OVR773O | 0.00 | | | | |
| OVR988Z | 0.00 | | | | |
| OVRC360 | 0.00 | | | | |
| OVR1005O | 0.42 | | | | |
| OVR1040O | 0.53 | | | | |
| OVR105O | 0.09 | | | | |
| OVR130X | 0.53 | | | | |
| OVR718O | 0.25 | | | | |
| OVRA1B | 0.26 | | | | |
| OVR247A | | | 0.00 | | |
| OVR35GA | | | 0.05 | | |
| OVRC087 | | | 0.00 | | |
| OVRC109 | | | 0.00 | | |
| OVR206I | | | 0.00 | | |
| OVR515O | | | 0.00 | | |
| OVR18GA | | | 0.00 | | |
| OVR337O | | | 0.00 | | |
| OVR123O | | | 0.38 | | |
| OVRC177 | | | 0.01 | | |
| OVR40G | | | 0.00 | | |
| OVR451O | | | 0.00 | | |
| BLD030B | 0.06 | 0.09 | | | |
| BLD520B | 0.20 | 0.03 | | | |
| BLDTR17 | 0.46 | 0.01 | | | |
| CLN401C | 0.18 | 0.22 | | | |
| CLNAS43 | 0.39 | 0.21 | | | |
| CLNAS98 | 0.31 | 0.47 | | | |
| CLNCM12 | 0.10 | 0.20 | | | |
| CLNDC19 | 0.40 | 0.07 | | | |
| CLNRC01 | 0.27 | 0.13 | | | |
| CLNRS53 | 0.15 | 0.33 | | | |
| CLNSG27 | 0.17 | 0.25 | | | |
| CLNTX01 | 0.13 | 0.20 | | | |
| CVXKS52 | 0.00 | 0.00 | | | |
| CVXNKS55 | 0.00 | 0.12 | | | |
| CVXNKS25 | 0.85 | 0.00 | | | |
| CVXNKS18 | 0.00 | 0.00 | | | |
| CVXNKS54 | 0.00 | 0.00 | | | |
| ENDO10479 | 0.13 | 0.00 | | | |
| ENDO28XA | 0.32 | 0.12 | | | |
| ENDO8XA | 0.07 | 0.40 | | | |
| KID106XD | 0.05 | 0.10 | | | |
| KID12XD | 0.04 | 0.12 | | | |
| KID10XD | 0.05 | 0.05 | | | |
| KID22K | 0.02 | 0.03 | | | |
| KID107XD | 0.00 | 0.04 | | | |
| LNG205L | 0.00 | 0.26 | | | |
| LNG315L | 0.38 | 0.00 | | | |
| LNG507L | 0.20 | 0.00 | | | |
| LNG528L | 0.37 | 0.37 | | | |
| LNG8837L | 0.10 | 0.06 | | | |
| LNGAC11 | 0.03 | 0.06 | | | |
| LNGAC39 | 0.58 | 0.63 | | | |
| LNGSQ80 | 0.21 | 0.19 | | | |
| LNGSQ81 | 0.15 | 0.00 | | | |
| LVR15XA | 0.00 | 0.00 | | | |
| LVR174L | 0.00 | 0.00 | | | |
| LVR187L | 0.00 | 0.37 | | | |
| MAM19DN | 0.12 | 0.25 | | | |
| MAM42DN | 0.44 | 0.64 | | | |
| MAM517 | 0.25 | 0.00 | | | |
| MAM781M | 0.24 | 0.67 | | | |
| MAM869M | 0.04 | 0.00 | | | |
| MAM976M | 0.22 | 0.00 | | | |
| MAMS570 | 0.00 | 0.47 | | | |
| MAMS699 | 0.00 | 0.00 | | | |
| MAMS997 | 0.11 | 0.04 | | | |
| PAN71XL | 1.10 | 0.31 | | | |
| PAN77X | 0.00 | 0.00 | | | |
| PAN92X | 0.19 | 0.00 | | | |
| PRO10R | | | | 0.00 | |
| PRO20R | | | | 0.20 | |
| PRO23B | 0.17 | 0.10 | | | |
| PRO263C | | | | 0.54 | |
| PRO276P | | | | | 0.27 |
| PRO65XB | 0.17 | 0.11 | | | |
| PRO675P | 0.47 | 0.85 | | | |
| PRO767B | | | | 0.10 | |
| PRO84XB | 0.12 | 0.13 | | | |
| PRO855P | | | | | 0.08 |
| PRO958P | 0.15 | 0.12 | | | |
| SKN287S | 0.10 | 0.00 | | | |
| SKN39A | 0.06 | 0.00 | | | |
| SKN669S | 0.00 | 0.51 | | | |
| SMINT171S | 0.38 | 0.67 | | | |
| SMINT20SM | 0.23 | 0.40 | | | |
| SMINTH89 | 0.14 | 0.31 | | | |
| STO261S | 0.69 | 0.24 | | | |
| STO288S | 0.36 | 0.17 | | | |
| STOAC93 | 0.00 | 0.00 | | | |
| STO88S | 0.00 | 0.17 | | | |
| THRD143N | 0.15 | 0.25 | | | |
| THRD270T | 0.37 | 0.28 | | | |

-continued

| Sample ID | CAN | NAT | NRM | BPH | PROST |
|---|---|---|---|---|---|
| THRD56T | 0.34 | 0.45 | | | |
| TST39X | 0.20 | 0.43 | | | |
| TST647T | 0.59 | 0.41 | | | |
| TST663T | 0.33 | 0.25 | | | |
| UTR135XO | 0.19 | 0.13 | | | |
| UTR85XU | 1.42 | 0.14 | | | |
| BLOB3 | | | 0.00 | | |
| BLOB11 | | | 0.00 | | |
| BLO69 | | | 0.00 | | |
| BLO72 | | | 0.00 | | |
| BLO73 | | | 0.00 | | |
| ADR48AD | | | 0.00 | | |
| BRN10BR | | | 0.00 | | |
| CLN01CL | | | 0.12 | | |
| CVX06CV | | | 0.00 | | |
| ESO01ES | | | 0.00 | | |
| HRT46HR | | | 0.00 | | |
| HUMREF00HR | 0.08 | | | | |
| KID55KD | | | 0.02 | | |
| LVR89LV | | | 0.00 | | |
| LNG90LN | | | 1.00 | | |
| MAM01MA | | | 0.10 | | |
| MSL84MU | | | 0.00 | | |
| OVR3APV | | | 0.03 | | |
| PAN04PA | | | 0.17 | | |
| PLA59PL | | | 0.00 | | |
| PRO09PR | | | 0.00 | | |
| REC21RC | | | 0.36 | | |
| SMINT59SM | | | 0.13 | | |
| SPL7GSP | | | 0.09 | | |
| STO09ST | | | 0.39 | | |
| THYM99TM | | | 0.00 | | |
| TRA16TR | | | 0.09 | | |
| TST4GTS | | | 0.50 | | |
| UTR57UT | | | 0.15 | | |

0.00 = Negative or Not Detected

The sensitivity for Ovr232v1 expression was calculated for the cancer samples versus normal samples. The sensitivity value indicates the percentage of cancer samples that show levels of Ovr232v1 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr232v1 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 33% | 44% | 0% | 0% |
| Sensitivity, Down vs. NAT | 22% | 22% | 33% | 0% | 0% |
| Sensitivity, Up vs. NRM | 44% | 0% | 44% | 62% | 100% |
| Sensitivity, Down vs. NRM | 0% | 89% | 33% | 0% | 0% |
| Specificity | 36.7% | 34.57% | 32.45% | 28.65% | 35.26% |

Altogether, the tissue specificity, plus the mRNA differential expression in the samples tested are believed to make Ovr232v1 a good marker for diagnosing, monitoring, staging, imaging and/or treating ovarian cancer.

Primers used for QPCR Expression Analysis of Ovr232v1 are as follows:

```
                                          (SEQ ID NO: 320)
(Ovr232v1_forward): GGCGGTGACTCATCAACGA (SEQ ID NO: 321)
(Ovr232v1_reverse): CATTGACGATTATTATTCACAAAGCA (SEQ ID NO: 322)
(Ovr232v1_probe):   GCGGCCAGAGAATGTGTCTGTGAAAACT
```

DEX0455__049.nt.3 (Ovr232v2)

The relative expression level of Ovr232v2 in various tissue samples is included below. Tissue samples include 72 pairs of matching samples, 12 non matched cancer samples, and 37 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to normal spleen sample SPL7GSP (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 20.82 | 1.47 | | | |
| OVRG010 | 7.06 | 0.00 | | | |
| OVRG021 | 2.01 | 0.55 | | | |
| OVR1157 | 17.09 | | | | |
| OVR773O | 31.56 | | | | |
| OVR988Z | 17.68 | | | | |
| OVRC360 | 0.00 | | | | |
| OVR1005O | 20.28 | | | | |
| OVR1040O | 29.36 | | | | |
| OVR105O | 15.24 | | | | |
| OVR130X | 10.08 | | | | |
| OVR718O | 12.73 | | | | |
| OVRA1B | 34.60 | | | | |
| OVR247A | | | 0.00 | | |
| OVR35GA | | | 0.11 | | |
| OVRC087 | | | 0.00 | | |
| OVRC109 | | | 0.00 | | |
| OVR206I | | | 0.43 | | |
| OVR515O | | | 1.11 | | |
| OVR18GA | | | 0.00 | | |
| OVR123O | | | 3.47 | | |
| OVRC177 | | | 0.08 | | |
| OVR40G | | | 0.06 | | |
| BLD030B | 6.81 | 0.00 | | | |
| BLD520B | 4.04 | 0.57 | | | |
| BLDTR17 | 3.89 | 2.17 | | | |
| CLN401C | 22.89 | 17.80 | | | |

-continued

| Sample ID | CAN | NAT | NRM | BPH | PROST |
|---|---|---|---|---|---|
| CLNAS43 | 72.65 | 16.04 | | | |
| CLNAS98 | 15.32 | 35.15 | | | |
| CLNCM12 | 17.48 | 29.75 | | | |
| CLNDC19 | 81.83 | 20.01 | | | |
| CLNRC01 | 20.30 | 18.70 | | | |
| CLNRS53 | 17.98 | 55.34 | | | |
| CLNSG27 | 59.40 | 41.80 | | | |
| CLNTX01 | 30.45 | 37.83 | | | |
| CVXKS52 | 3.47 | 2.77 | | | |
| CVXNKS55 | 12.43 | 2.43 | | | |
| CVXNKS18 | 0.00 | 0.54 | | | |
| CVXNKS54 | 13.64 | 2.13 | | | |
| ENDO10479 | 95.97 | 4.22 | | | |
| ENDO28XA | 39.72 | 8.50 | | | |
| ENDO8XA | 3.02 | 11.79 | | | |
| KID106XD | 0.18 | 1.97 | | | |
| KID12XD | 1.46 | 10.05 | | | |
| KID10XD | 0.35 | 1.92 | | | |
| KID22K | 0.65 | 1.57 | | | |
| KID107XD | 4.13 | 2.74 | | | |
| LNG205L | 3.09 | 13.46 | | | |
| LNG315L | 18.48 | 9.39 | | | |
| LNG507L | 15.67 | 4.96 | | | |
| LNG528L | 78.28 | 10.67 | | | |
| LNG8837L | 14.25 | 6.13 | | | |
| LNGAC11 | 7.45 | 16.04 | | | |
| LNGAC39 | 151.52 | 5.87 | | | |
| LNGSQ80 | 27.78 | 24.91 | | | |
| LNGSQ81 | 9.10 | 5.92 | | | |
| LVR15XA | 0.27 | 0.09 | | | |
| LVR174L | 0.00 | 0.23 | | | |
| LVR187L | 0.00 | 85.59 | | | |
| MAM19DN | 7.21 | 18.30 | | | |
| MAM42DN | 29.31 | 5.38 | | | |
| MAM517 | 13.24 | 1.54 | | | |
| MAM781M | 26.05 | 0.95 | | | |
| MAM869M | 4.02 | 0.00 | | | |
| MAM976M | 13.42 | 2.33 | | | |
| MAMS570 | 4.31 | 5.78 | | | |
| MAMS699 | 1.12 | 4.34 | | | |
| MAMS997 | 13.01 | 5.21 | | | |
| PAN71XL | 64.87 | 58.75 | | | |
| PAN77X | 0.00 | 0.00 | | | |
| PAN92X | 26.90 | 0.00 | | | |
| PRO10R | | | | | 2.57 |
| PRO20R | | | | | 5.10 |
| PRO23B | 3.74 | 3.66 | | | |
| PRO263C | | | | 3.92 | |
| PRO276P | | | | 1.99 | |
| PRO65XB | 3.35 | 4.51 | | | |
| PRO675P | 8.17 | 1.15 | | | |
| PRO767B | | | | 10.45 | |
| PRO84XB | 5.75 | 3.97 | | | |
| PRO855P | | | | 3.29 | |
| PRO958P | 2.91 | 5.35 | | | |
| SKN287S | 5.73 | 0.91 | | | |
| SKN39A | 0.00 | | | | |
| SKN669S | 0.13 | 2.14 | | | |
| SMINT171S | 56.03 | 62.72 | | | |
| SMINT20SM | 106.47 | 33.80 | | | |
| SMINTH89 | 96.97 | 40.02 | | | |

-continued

| Sample ID | CAN | NAT | NRM | BPH | PROST |
|---|---|---|---|---|---|
| STO261S | 118.64 | 19.05 | | | |
| STO288S | 47.55 | 4.07 | | | |
| STOAC93 | 67.18 | 64.23 | | | |
| STO88S | 79.32 | | | | |
| THRD143N | 14.71 | 30.26 | | | |
| THRD270T | 43.65 | 40.86 | | | |
| THRD56T | 23.82 | 8.72 | | | |
| TST39X | 6.89 | 5.65 | | | |
| TST647T | 30.28 | 3.55 | | | |
| TST663T | 23.55 | 1.69 | | | |
| UTR135XO | 2.75 | 5.63 | | | |
| UTR85XU | 32.07 | 28.53 | | | |
| BLOB3 | | | 2.60 | | |
| BLOB11 | | | 0.00 | | |
| BLO69 | | | 0.00 | | |
| BLO72 | | | 0.34 | | |
| BLO73 | | | 0.00 | | |
| ADR48AD | | | 0.00 | | |
| BRN10BR | | | 0.47 | | |
| CLN01CL | | | 24.82 | | |
| ESO01ES | | | 0.00 | | |
| HRT46HR | | | 0.00 | | |
| HUMREF00HR | | 4.31 | | | |
| KID55KD | | | 2.28 | | |
| LVR89LV | | | 0.02 | | |
| LNG90LN | | | 10.08 | | |
| MAM01MA | | | 1.17 | | |
| MSL84MU | | | 0.00 | | |
| OVR3APV | | | 0.02 | | |
| PAN04PA | | | 0.61 | | |
| PLA59PL | | | 0.00 | | |
| PRO09PR | | | 8.47 | | |
| REC21RC | | | 95.94 | | |
| SMINT59SM | | | 16.37 | | |
| SPL7GSP | | | 1.00 | | |
| STO09ST | | | 2.19 | | |
| THYM99TM | | | 0.83 | | |
| TRA16TR | | | 6.78 | | |
| TST4GTS | | | 1.57 | | |
| UTR57UT | | | 2.24 | | |

0.00 = Negative or Not Detcted

The sensitivity for Ovr232v2 expression was calculated for the cancer samples versus normal samples. The sensitivity value indicates the percentage of cancer samples that show levels of Ovr232v2 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr232v2 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 44% | 67% | 0% | 20% |
| Sensitivity, Down vs. NAT | 22% | 22% | 22% | 0% | 0% |
| Sensitivity, Up vs. NRM | 33% | 33% | 89% | 92% | 0% |
| Sensitivity, Down vs. NRM | 0% | 11% | 0% | 8% | 60% |
| Specificity | 36.46% | 29.28% | 25.41% | 24.28% | 19.13% |

Altogether, the tissue specificity, plus the mRNA differential expression in the samples tested are believed to make Ovr232v2 a good marker for diagnosing, monitoring, staging, imaging and/or treating ovarian cancer.

Primers used for QPCR Expression Analysis of Ovr232v2 are as follows:

```
                                        (SEQ ID NO: 323)
(Ovr232v2_forward):  CCTTTTTATCCACTTACAGATCAACCA (SEQ ID NO: 324)
(Ovr232v2_reverse):  ACAAGCAAGATGCATGTGAGTGA (SEQ ID NO: 325)
(Ovr232v2_probe):    ATGGTTCGCTGCTGCCGTT
```

DEX0455_049.nt.4 (Ovr232v3)

The relative expression level of Ovr232v3 in various tissue samples is included below. Tissue samples include 75 pairs of matching samples, 10 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to normal lung sample LNG90LN (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.00 | 0.00 | | | |
| OVRG010 | 0.07 | 0.00 | | | |
| OVRG021 | 0.00 | 0.00 | | | |
| OVR1157 | 0.01 | | | | |
| OVR773O | 0.00 | | | | |
| OVR988Z | 0.00 | | | | |
| OVRC360 | 0.00 | | | | |
| OVR1005O | 0.52 | | | | |
| OVR1040O | 0.55 | | | | |
| OVR105O | 0.25 | | | | |
| OVR130X | 0.00 | | | | |
| OVR718O | 0.29 | | | | |
| OVRA1B | 0.22 | | | | |
| OVR247A | | | 0.00 | | |
| OVRC087 | | | 0.00 | | |
| OVRC109 | | | 0.00 | | |
| OVR206I | | | 0.00 | | |
| OVR515O | | | 0.00 | | |
| OVR18GA | | | 0.00 | | |
| OVR337O | | | 0.00 | | |
| OVR123O | | | 0.00 | | |
| OVRC177 | | | 0.00 | | |
| OVR40G | | | 0.00 | | |
| OVR451O | | | 0.00 | | |
| BLD030B | 0.12 | 0.00 | | | |
| BLD520B | 0.00 | 0.00 | | | |
| BLDTR17 | 0.00 | 0.02 | | | |
| CLN401C | 0.57 | 0.24 | | | |
| CLNAS43 | 1.60 | 0.00 | | | |
| CLNAS98 | 0.86 | 0.00 | | | |
| CLNCM12 | 0.06 | 0.06 | | | |
| CLNDC19 | 0.47 | 0.03 | | | |
| CLNRC01 | 0.12 | 0.12 | | | |
| CLNRS53 | 0.00 | 0.00 | | | |
| CLNSG27 | 1.08 | 0.00 | | | |
| CLNTX01 | 0.00 | 0.41 | | | |
| CVXKS52 | 0.00 | 0.00 | | | |
| CVXNKS55 | 0.00 | 0.00 | | | |
| CVXNKS25 | 0.00 | 0.00 | | | |
| CVXNKS18 | 0.00 | 0.00 | | | |
| CVXNKS54 | 0.00 | 0.00 | | | |
| ENDO10479 | 0.30 | 0.00 | | | |
| ENDO28XA | 0.19 | 0.00 | | | |
| ENDO8XA | 0.00 | 0.46 | | | |
| KID106XD | 0.00 | 0.00 | | | |
| KID12XD | 0.00 | 0.00 | | | |
| KID10XD | 0.00 | 0.04 | | | |
| KID22K | 0.00 | 0.02 | | | |
| KID107XD | 0.00 | 0.12 | | | |
| LNG205L | 0.00 | 0.68 | | | |
| LNG315L | 0.00 | 0.00 | | | |
| LNG507L | 0.00 | 0.00 | | | |
| LNG528L | 1.50 | 0.00 | | | |
| LNG8837L | 0.96 | 0.81 | | | |
| LNGAC11 | 0.03 | 0.00 | | | |
| LNGAC39 | 0.35 | 1.20 | | | |
| LNGSQ80 | 0.87 | 0.00 | | | |
| LNGSQ81 | 0.65 | 0.00 | | | |
| LVR15XA | 0.10 | 0.00 | | | |
| LVR174L | 0.00 | 0.00 | | | |
| LVR187L | 0.00 | 0.38 | | | |
| MAM19DN | 0.00 | 0.00 | | | |
| MAM42DN | 0.00 | 0.07 | | | |
| MAM517 | 0.00 | 0.00 | | | |
| MAM781M | 0.00 | 0.00 | | | |
| MAM869M | 0.00 | 0.00 | | | |
| MAM976M | 0.00 | 0.00 | | | |
| MAMS570 | 0.00 | 0.00 | | | |
| MAMS699 | 0.00 | 0.00 | | | |
| MAMS997 | 0.05 | 0.21 | | | |
| PAN71XL | 0.00 | 0.64 | | | |
| PAN77X | 0.00 | 0.00 | | | |
| PAN92X | 0.19 | 0.00 | | | |
| PRO10R | | | | | 0.00 |
| PRO20R | | | | | 0.00 |
| PRO23B | 0.04 | 0.00 | | | |
| PRO263C | | | | 0.00 | |
| PRO276P | | | | 0.00 | |
| PRO65XB | 0.09 | 0.00 | | | |
| PRO675P | 0.68 | 0.00 | | | |
| PRO767B | | | | 0.09 | |
| PRO84XB | 0.00 | 0.00 | | | |
| PRO855P | | | | | 0.01 |
| PRO958P | 0.00 | 0.00 | | | |
| SKN287S | 0.06 | 0.00 | | | |
| SKN39A | 0.00 | 0.00 | | | |
| SKN669S | 0.00 | 0.00 | | | |
| SMINT171S | 0.03 | 0.00 | | | |
| SMINT20SM | 0.55 | 0.24 | | | |
| SMINTH89 | 0.00 | 0.47 | | | |
| STO261S | 1.03 | 0.00 | | | |
| STO288S | 0.54 | 0.00 | | | |
| STOAC93 | 0.00 | 2.29 | | | |
| STO88S | 0.00 | 0.00 | | | |
| THRD143N | 0.51 | 2.00 | | | |
| THRD270T | 0.49 | 0.97 | | | |
| THRD56T | 0.79 | 0.00 | | | |
| TST39X | 0.00 | 0.00 | | | |
| TST647T | 0.52 | 0.59 | | | |
| TST663T | 0.40 | 0.46 | | | |
| UTR135XO | 0.00 | 0.00 | | | |
| UTR85XU | 0.77 | 0.29 | | | |
| BLOB3 | | | 0.00 | | |
| BLOB11 | | | 0.00 | | |
| BLO69 | | | 0.00 | | |
| BLO72 | | | 0.00 | | |
| BLO73 | | | 0.00 | | |
| ADR48AD | | | 0.00 | | |
| BRN10BR | | | 0.00 | | |
| CLN01CL | | | 0.03 | | |
| CVX06CV | | | 0.00 | | |
| ESO01ES | | | 0.00 | | |

-continued

| Sample ID | CAN | NAT | NRM | BPH | PROST |
|---|---|---|---|---|---|
| HRT46HR | | | 0.00 | | |
| HUMREF00HR | 0.00 | | | | |
| KID55KD | | | 0.01 | | |
| LVR89LV | | | 0.00 | | |
| LNG90LN | | | 1.00 | | |
| MAM01MA | | | 0.06 | | |
| MSL84MU | | | 0.00 | | |
| OVR3APV | | | 0.01 | | |
| PAN04PA | | | 0.00 | | |
| PLA59PL | | | 0.00 | | |
| PRO09PR | | | 0.00 | | |
| REC21RC | | | 1.27 | | |
| SMINT59SM | | | 0.00 | | |
| SPL7GSP | | | 0.00 | | |
| STO09ST | | | 0.00 | | |
| THYM99TM | | | 0.00 | | |
| TRA16TR | | | 0.00 | | |
| TST4GTS | | | 1.21 | | |
| UTR57UT | | | 0.00 | | |

0.00 = Negative or Not Detected

The sensitivity for Ovr232v3 expression was calculated for the cancer samples versus normal samples. The sensitivity value indicates the percentage of cancer samples that show levels of Ovr232v3 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr232v3 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 56% | 44% | 0% | 0% | 60% |
| Sensitivity, Down vs. NAT | 11% | 22% | 22% | 0% | 0% |
| Sensitivity, Up vs. NRM | 78% | 0% | 0% | 62% | 60% |
| Sensitivity, Down vs. NRM | 22% | 56% | 89% | 0% | 0% |
| Specificity | 72.73% | 70.59% | 61.5% | 62.36% | 63.49% |

Altogether, the tissue specificity, plus the mRNA differential expression in the samples tested are believed to make Ovr232v3 a good marker for diagnosing, monitoring, staging, imaging and/or treating ovarian cancer.

Primers used for QPCR Expression Analysis of Ovr232v3 are as follows:

```
(Ovr232v3_forward):
                                    (SEQ ID NO: 326)
CCTCACTTCGCAGCTTTGCT (Ovr232v3_reverse):
                                    (SEQ ID NO: 327)
CTGGCATTGACGATTATTATTCACA (Ovr232v3probe):
                                    (SEQ ID NO: 328)
CTGTGAAAACTACAAGCTGGCCGTAAACTGCT
```

DEX0455__052.nt.2 (Ovr107v1)

The relative expression level of Ovr107v1 in various tissue samples is included below. Tissue samples include 69 pairs of matching samples, 14 non matched cancer samples, and 33 normal samples, all from various tissues annotated in the table. A matching pair is formed by mRNA from the cancer sample for a particular tissue and mRNA from the normal adjacent sample for that same tissue from the same individual. Of the normal samples 2 were blood samples which measured the expression levels in blood cells. Additionally, 2 prostatitis, and 4 Benign Prostatic Hyperplasia (BPH) samples are included. All the values are compared to prostate normal sample PRO09PR (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 1.11 | 0.00 | | | |
| OVRG010 | 0.00 | 6.59 | | | |
| OVRG021 | 0.36 | 0.35 | | | |
| OVR1157 | 3.79 | | | | |
| OVR7730 | 7.68 | | | | |
| OVR814O | 1.90 | | | | |
| OVRC360 | 0.00 | | | | |
| OVR1005O | 4.09 | | | | |
| OVR1040O | 3.29 | | | | |
| OVR105O | 4.05 | | | | |
| OVR130X | 0.00 | | | | |
| OVR718O | 0.84 | | | | |
| OVRA1B | 3.99 | | | | |
| OVR247A | | | 0.12 | | |
| OVR35GA | | | 0.14 | | |
| OVRC087 | | | 0.06 | | |
| OVRC109 | | | 0.22 | | |
| OVR206I | | | 0.42 | | |
| OVR515O | | | 0.00 | | |
| OVR18GA | | | 0.00 | | |
| OVRC177 | | | 0.02 | | |
| OVR40G | | | 0.00 | | |
| BLD030B | 0.79 | 0.00 | | | |
| BLD520B | 0.10 | 0.12 | | | |
| BLDTR17 | 2.53 | 1.19 | | | |
| CLN401C | 0.26 | 0.44 | | | |
| CLNAS43 | 4.02 | 1.01 | | | |
| CLNAS98 | 1.42 | 0.50 | | | |
| CLNCM12 | 1.48 | 0.45 | | | |
| CLNDC19 | 2.32 | 0.79 | | | |
| CLNRC01 | 0.33 | 0.15 | | | |
| CLNRS53 | 0.31 | 0.88 | | | |
| CLNSG27 | 2.00 | 1.15 | | | |
| CLNTX01 | 0.00 | 0.00 | | | |
| CVXKS52 | 1.77 | 3.80 | | | |
| CVXNK23 | 1.76 | | | | |
| CVXNKS54 | 2.77 | 3.22 | | | |
| CVXNKS55 | 6.45 | 9.73 | | | |
| CVXNKS81 | 2.00 | | | | |
| ENDO10479 | 5.01 | 1.45 | | | |
| ENDO28XA | 5.66 | 0.29 | | | |
| ENDO8XA | 0.85 | 0.18 | | | |
| KID106XD | 0.00 | 0.61 | | | |
| KID107XD | 0.44 | 1.12 | | | |
| KID109XD | 2.85 | 0.99 | | | |
| KID10XD | 0.00 | 0.09 | | | |
| KID22K | 0.32 | 0.03 | | | |
| LNG205L | 0.26 | 1.68 | | | |
| LNG315L | 0.44 | 0.44 | | | |
| LNG507L | 0.24 | 0.00 | | | |
| LNG528L | 0.19 | 0.17 | | | |
| LNG8837L | 1.07 | 0.62 | | | |
| LNGAC11 | 0.63 | 0.30 | | | |
| LNGAC39 | 1.29 | 1.24 | | | |

-continued

| Sample ID | CAN | NAT | NRM | BPH | PROST |
|---|---|---|---|---|---|
| LNGSQ80 | 1.39 | 0.25 | | | |
| LNGSQ81 | 1.23 | 0.56 | | | |
| LVR15XA | 0.00 | 0.04 | | | |
| LVR174L | 0.00 | 0.02 | | | |
| LVR187L | 0.25 | 0.86 | | | |
| MAM19DN | 1.91 | 1.04 | | | |
| MAM42DN | 0.36 | 0.00 | | | |
| MAM517 | | 0.00 | | | |
| MAM781M | 0.00 | 0.53 | | | |
| MAM869M | 1.40 | 1.23 | | | |
| MAM976M | 2.55 | 0.00 | | | |
| MAMS570 | 0.00 | 1.69 | | | |
| MAMS699 | 1.35 | 0.00 | | | |
| MAMS997 | 2.41 | 1.23 | | | |
| PAN71XL | 0.72 | 0.00 | | | |
| PAN82XP | 0.71 | | | | |
| PAN92X | 5.33 | | | | |
| PRO23B | 1.06 | 0.93 | | | |
| PRO65XB | 0.61 | 0.70 | | | |
| PRO675P | 0.57 | 0.48 | | | |
| PRO84XB | 0.62 | 0.75 | | | |
| PRO958P | 1.10 | 1.03 | | | |
| PRO263C | | | | 1.38 | |
| PRO276P | | | | 0.66 | |
| PRO767B | | | | 2.26 | |
| PRO855P | | | | 0.76 | |
| PRO10R | | | | | 0.26 |
| PRO20R | | | | | 0.36 |
| SKN287S | 2.27 | 0.00 | | | |
| SKN39A | 0.54 | 0.00 | | | |
| SKN669S | 0.52 | 6.42 | | | |
| SMINT171S | 1.91 | 0.09 | | | |
| SMINT20SM | 3.08 | 1.13 | | | |
| SMINTH89 | 1.92 | 1.28 | | | |
| STO261S | 1.20 | 0.35 | | | |

-continued

| Sample ID | CAN | NAT | NRM | BPH | PROST |
|---|---|---|---|---|---|
| STO288S | 0.14 | 0.29 | | | |
| STO88S | 0.58 | 0.00 | | | |
| THRD143N | 1.09 | 6.12 | | | |
| THRD270T | 5.60 | 6.15 | | | |
| THRD56T | 2.63 | 2.16 | | | |
| TST39X | 0.58 | 0.29 | | | |
| TST647T | 0.41 | 0.03 | | | |
| TST663T | 0.95 | 0.07 | | | |
| UTR135XO | 0.63 | 1.00 | | | |
| UTR85XU | 0.00 | 0.19 | | | |
| BLOB3 | | | 0.35 | | |
| BLOB11 | | | 0.00 | | |
| ADR48AD | | | 0.00 | | |
| BRN10BR | | | 0.00 | | |
| CLN01CL | | | 0.79 | | |
| ESO01ES | | | 1.69 | | |
| HRT46HR | | | 0.00 | | |
| HUMREF00HR | 0.67 | | | | |
| KID55KD | | | 0.17 | | |
| LVR89LV | | | 0.00 | | |
| LNG90LN | | | 0.36 | | |
| MAM01MA | | | 0.55 | | |
| MSL84MU | | | 0.00 | | |
| OVR3APV | | | 0.33 | | |

-continued

| Sample ID | CAN | NAT | NRM | BPH | PROST |
|---|---|---|---|---|---|
| PAN04PA | | | 0.24 | | |
| PLA59PL | | | 5.67 | | |
| PRO09PR | | | 1.00 | | |
| REC21RC | | | 0.51 | | |
| SMINT59SM | | | 0.12 | | |
| SPL7GSP | | | 0.08 | | |
| STO09ST | | | 2.33 | | |
| THYM99TM | | | 0.20 | | |
| TRA16TR | | | 2.37 | | |
| TST4GTS | | | 0.33 | | |
| UTR57UT | | | 0.32 | | |

Note:
0.00 = Negative or Not Detected

The sensitivity for Ovr107v1 expression was calculated for the cancer samples versus normal samples. The sensitivity value indicates the percentage of cancer samples that show levels of Ovr107v1 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr107v1 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 56% | 44% | 38% | 0% | 0% |
| Sensitivity, Down vs. NAT | 11% | 11% | 25% | 0% | 0% |
| Sensitivity, Up vs. NRM | 33% | 44% | 63% | 77% | 0% |
| Sensitivity, Down vs. NRM | 44% | 0% | 25% | 23% | 0% |
| Specificity | 25.86% | 21.26% | 22.86% | 25.15% | 21.59% |

Altogether, the tissue specificity, plus the mRNA differential expression in the samples tested are believed to make Ovr107v1 a good marker for diagnosing, monitoring, staging, imaging and/or treating ovarian cancer.

Primers used for QPCR Expression Analysis of Ovr107v1 are as follows:

```
                                    (SEQ ID NO: 329)
(Ovr107v1_forward):  CGCCTGACCCGACTGTCTTA (SEQ ID NO: 330)
(Ovr107v1_reverse):  GCTCAGATTCTGGCTCCAAGTCT (SEQ ID NO: 331)
(Ovr107v1_probe):    CCTACAGCAAAGCGCCCCCA
```

DEX0455__052.nt.4 (Ovr107v3)

The relative expression level of Ovr107v3 in various tissue samples is included below. Tissue samples include 73 pairs of matching samples, 11 non matched cancer samples, and 37 normal samples, all from various tissues annotated in the table. A matching pair is formed by mRNA from the cancer sample for a particular tissue and mRNA from the normal adjacent sample for that same tissue from the same individual. Of the normal samples 4 were blood samples which measured the expression levels in blood cells. Additionally, 2 prostatitis, and 4 Benign Prostatic Hyperplasia (BPH) samples are included. All the values are compared to ovarian cancer sample OVR8140 (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample | CAN | NAT | NRM | BPH | PROST |
|---|---|---|---|---|---|
| OVRA084 | 0.32 | 0.10 | | | |
| OVRG010 | 0.01 | 4.12 | | | |
| OVRG021 | 0.17 | 0.04 | | | |
| OVR1157 | 2.88 | | | | |
| OVR773O | 6.48 | | | | |
| OVR814O | 1.00 | | | | |
| OVRC360 | 0.11 | | | | |
| OVR1005O | 1.56 | | | | |
| OVR1040O | 1.09 | | | | |
| OVR105O | 0.68 | | | | |
| OVR130X | 1.17 | | | | |
| OVR718O | 0.79 | | | | |
| OVRA1B | 1.43 | | | | |
| OVR247A | | | 0.06 | | |
| OVR35GA | | | 0.03 | | |
| OVRC087 | | | 0.03 | | |
| OVRC109 | | | 0.01 | | |
| OVR206I | | | 0.08 | | |
| OVR515O | | | 0.09 | | |
| OVR18GA | | | 0.03 | | |
| OVR337O | | | 0.00 | | |
| OVR123O | | | 0.00 | | |
| OVRC177 | | | 0.04 | | |
| OVR40G | | | 0.05 | | |
| BLD030B | 0.16 | 0.00 | | | |
| BLD520B | 0.09 | 0.03 | | | |
| BLDTR17 | 0.06 | 0.16 | | | |
| CLN401C | 0.09 | 0.10 | | | |
| CLNAS43 | 0.24 | 0.03 | | | |
| CLNAS98 | 0.14 | 0.11 | | | |
| CLNCM12 | 0.05 | 0.11 | | | |
| CLNDC19 | 0.40 | 0.14 | | | |
| CLNRC01 | 0.05 | 0.07 | | | |
| CLNRS53 | 0.06 | 0.16 | | | |
| CLNSG27 | 0.11 | 0.12 | | | |
| CLNTX01 | 0.07 | 0.02 | | | |
| CVXKS52 | 0.50 | 1.56 | | | |
| CVXNK23 | 0.51 | 2.02 | | | |
| CVXNKS54 | 0.56 | 0.93 | | | |
| CVXNKS55 | 1.32 | 3.28 | | | |
| CVXNKS81 | 0.55 | 1.16 | | | |
| ENDO10479 | 1.12 | 0.12 | | | |
| ENDO28XA | 1.33 | 0.11 | | | |
| ENDO8XA | 0.30 | 0.07 | | | |
| KID106XD | 0.01 | 0.03 | | | |
| KID107XD | 0.03 | 0.13 | | | |
| KID109XD | 0.25 | 0.04 | | | |
| KID10XD | 0.02 | 0.01 | | | |
| KID22K | 0.07 | 0.03 | | | |
| LNG205L | 0.03 | 0.05 | | | |
| LNG315L | 0.03 | 0.08 | | | |
| LNG507L | 0.58 | 0.07 | | | |
| LNG528L | 0.29 | 0.06 | | | |
| LNG8837L | 0.09 | 0.17 | | | |
| LNGAC11 | 0.14 | 0.15 | | | |
| LNGAC39 | 0.50 | 0.08 | | | |
| LNGSQ80 | 0.18 | 0.22 | | | |
| LNGSQ81 | 0.07 | 0.16 | | | |
| LVR15XA | 0.00 | 0.01 | | | |
| LVR174L | 0.01 | 0.01 | | | |
| LVR187L | 0.01 | 0.19 | | | |
| MAM19DN | 0.62 | 0.28 | | | |
| MAM42DN | 0.57 | 0.37 | | | |
| MAM517 | 2.06 | 0.15 | | | |
| MAM781M | 0.07 | 0.06 | | | |
| MAM869M | 0.67 | 0.11 | | | |
| MAM976M | 0.60 | 0.16 | | | |
| MAMS570 | 0.72 | 0.76 | | | |
| MAMS699 | 0.10 | 0.46 | | | |
| MAMS997 | 0.18 | 0.34 | | | |
| PAN71XL | 0.09 | 0.02 | | | |
| PAN82XP | 0.12 | | | | |
| PAN92X | 2.58 | 0.00 | | | |
| PRO23B | 0.23 | 0.27 | | | |
| PRO65XB | 0.22 | 0.25 | | | |
| PRO675P | 0.40 | 0.19 | | | |
| PRO84XB | 0.34 | 0.42 | | | |
| PRO958P | 0.38 | 0.22 | | | |
| PRO263C | | | | 0.30 | |
| PRO276P | | | | 0.24 | |
| PRO767B | | | | 0.93 | |
| PRO855P | | | | 0.44 | |
| PRO10R | | | | | 0.32 |
| PRO20R | | | | | 0.19 |
| SKN287S | 0.86 | 0.00 | | | |
| SKN39A | 0.03 | 0.00 | | | |
| SKN669S | 0.12 | 0.40 | | | |
| SMINT171S | 0.21 | 0.04 | | | |
| SMINT20SM | 2.32 | 0.40 | | | |
| SMINTH89 | 0.51 | 0.05 | | | |
| STO261S | 0.65 | 0.05 | | | |
| STO288S | 0.08 | 0.03 | | | |
| STO88S | 0.15 | 0.07 | | | |
| THRD143N | 0.09 | 0.73 | | | |
| THRD270T | 1.23 | 1.14 | | | |
| THRD56T | 0.64 | 0.18 | | | |
| TST39X | 0.07 | 0.02 | | | |
| TST647T | 0.11 | 0.01 | | | |
| TST663T | 0.12 | 0.03 | | | |
| UTR135XO | 0.13 | 0.27 | | | |
| UTR85XU | 0.15 | 0.09 | | | |
| BLOB3 | | | 0.00 | | |
| BLOB6 | | | 0.69 | | |
| BLOB11 | | | 0.02 | | |
| BLO982B | | | 0.10 | | |
| ADR48AD | | | 0.02 | | |
| BRN10BR | | | 0.01 | | |
| CLN01CL | | | 0.05 | | |
| ESO01ES | | | 0.93 | | |
| HRT46HR | | | 0.00 | | |
| HUMREF00HR | 0.09 | | | | |
| KID55KD | | | 0.05 | | |
| LVR89LV | | | 0.00 | | |
| LNG90LN | | | 0.04 | | |
| MAM01MA | | | 0.15 | | |
| MSL84MU | | | 0.01 | | |
| OVR3APV | | | 0.07 | | |
| PAN04PA | | | 0.10 | | |
| PLA59PL | | | 0.82 | | |
| PRO09PR | | | 0.50 | | |
| REC21RC | | | 0.26 | | |
| SMINT59SM | | | 0.03 | | |
| SPL7GSP | | | 0.03 | | |
| STO09ST | | | 1.10 | | |
| THYM99TM | | | 0.02 | | |
| TRA16TR | | | 0.32 | | |
| TST4GTS | | | 0.01 | | |
| UTR57UT | | | 0.08 | | |

Note:
0.00 = Negative or Not Detected

The sensitivity for Ovr107v3 expression was calculated for the cancer samples versus normal samples. The sensitivity value indicates the percentage of cancer samples that show levels of Ovr107v3 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr107v3 being useful as an ovarian cancer diagnostic marker and/or therapeutic target.

Sensitivity and specificity data is reported in the table below.

|  | CLN | LNG | MAM | OVR | PRO |
|---|---|---|---|---|---|
| Sensitivity, Up vs. NAT | 33% | 33% | 44% | 0% | 20% |
| Sensitivity, Down vs. NAT | 22% | 22% | 11% | 0% | 0% |
| Sensitivity, Up vs. NRM | 44% | 67% | 67% | 92% | 0% |
| Sensitivity, Down vs. NRM | 0% | 0% | 11% | 8% | 40% |
| Specificity | 8.79% | 10.44% | 33.52% | 43.35% | 21.74% |

Altogether, the tissue specificity, plus the mRNA differential expression in the samples tested are believed to make Ovr107v3 a good marker for diagnosing, monitoring, staging, imaging and/or treating ovarian cancer.

Primers used for QPCR Expression Analysis of Ovr107v3 are as follows:

```
                          (SEQ ID NO: 332)
(Ovr107v3_forward):   CCTGCAGCCCAGAGCAAT (SEQ ID NO: 333)
(Ovr107v3_reverse):   GCTCAGATTCTGGCTCCAAGTC (SEQ ID NO: 334)
(Ovr107v3_probe):     ATCTCCAACCCTCCCGCTTCT
```

DEX0455__051.nt.6 (Ovr107v4)

The relative expression level of Ovr107v4 in various tissue samples is included below. Tissue samples include 69 pairs of matching samples, 15 non matched cancer samples, and 34 normal samples, all from various tissues annotated in the table. A matching pair is formed by mRNA from the cancer sample for a particular tissue and mRNA from the normal adjacent sample for that same tissue from the same individual. Of the normal samples 2 were blood samples which measured the expression levels in blood cells. Additionally, 2 prostatitis, and 4 Benign Prostatic Hyperplasia (BPH) samples are included. All the values are compared to breast normal sample MAM01 MA (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 1.03 | 0.60 | | | |
| OVRG010 | 0.43 | 1.15 | | | |
| OVRG021 | 0.72 | 1.63 | | | |
| OVR1157 | 0.00 | | | | |
| OVR773O | 2.63 | | | | |
| OVR814O | 1.26 | | | | |
| OVRC360 | 0.46 | | | | |
| OVR1005O | 13.92 | | | | |
| OVR1040O | 6.00 | | | | |
| OVR105O | 6.04 | | | | |
| OVR718O | 4.15 | | | | |
| OVRA1B | 3.67 | | | | |
| OVR247A | | | 0.55 | | |
| OVR35GA | | | 1.06 | | |
| OVRC087 | | | 0.35 | | |
| OVRC109 | | | 0.43 | | |
| OVR206I | | | 0.93 | | |
| OVR515O | | | 2.17 | | |
| OVR18GA | | | 1.17 | | |
| OVRC177 | | | 0.68 | | |
| OVR40G | | | 1.89 | | |
| OVRC004 | | | 0.00 | | |
| BLD030B | 0.77 | 0.00 | | | |
| BLD520B | 2.75 | 0.88 | | | |
| BLDTR17 | 0.70 | 2.67 | | | |
| CLN401C | 0.78 | 1.03 | | | |
| CLNAS43 | 2.36 | 0.77 | | | |
| CLNAS98 | 1.73 | 1.27 | | | |
| CLNCM12 | 0.67 | 0.61 | | | |
| CLNDC19 | 1.46 | 0.43 | | | |
| CLNRC01 | 0.12 | 0.36 | | | |
| CLNRS53 | 0.36 | 2.08 | | | |
| CLNSG27 | 0.48 | 2.08 | | | |
| CLNTX01 | 0.72 | 0.56 | | | |
| CVXKS52 | 1.32 | 10.88 | | | |
| CVXNK23 | 2.75 | | | | |
| CVXNKS54 | 1.33 | 10.06 | | | |
| CVXNKS55 | 9.56 | 20.77 | | | |
| CVXNKS81 | 3.27 | | | | |
| ENDO10479 | 3.77 | 4.17 | | | |
| ENDO28XA | 5.41 | 4.55 | | | |
| ENDO8XA | 1.21 | 1.31 | | | |
| KID106XD | 0.27 | 0.12 | | | |
| KID107XD | 0.60 | 0.45 | | | |
| KID109XD | 2.94 | 0.76 | | | |
| KID10XD | 0.18 | 0.28 | | | |
| KID22K | 0.80 | 0.15 | | | |
| LNG205L | 0.46 | 1.80 | | | |
| LNG315L | 0.37 | 2.06 | | | |
| LNG507L | 1.43 | | | | |
| LNG528L | 1.26 | 0.85 | | | |
| LNG8837L | 0.86 | 1.74 | | | |
| LNGAC11 | 0.77 | 1.37 | | | |
| LNGAC39 | 1.28 | 1.22 | | | |
| LNGSQ80 | 1.34 | 2.91 | | | |
| LNGSQ81 | 0.95 | 1.01 | | | |
| LVR15XA | 0.05 | 0.06 | | | |
| LVR174L | 0.10 | 0.05 | | | |
| LVR187L | 0.00 | 0.86 | | | |
| MAM19DN | 1.31 | 3.79 | | | |
| MAM42DN | 1.98 | 3.48 | | | |
| MAM517 | 3.35 | 0.00 | | | |
| MAM781M | 0.57 | 0.51 | | | |
| MAM869M | 2.29 | 1.06 | | | |
| MAM976M | 3.78 | 2.13 | | | |
| MAMS570 | 2.14 | 3.13 | | | |
| MAMS699 | 0.58 | 4.99 | | | |
| MAMS997 | 2.72 | 1.84 | | | |
| PAN71XL | 0.76 | 0.24 | | | |
| PAN82XP | 1.49 | | | | |
| PAN92X | 4.92 | | | | |
| PRO23B | 0.87 | 1.01 | | | |
| PRO65XB | 0.62 | 0.72 | | | |
| PRO675P | 1.19 | 2.30 | | | |
| PRO84XB | 0.99 | 2.38 | | | |
| PRO958P | 1.31 | 1.39 | | | |
| PRO263C | | | | 1.64 | |
| PRO276P | | | | 0.60 | |
| PRO767B | | | | 3.10 | |
| PRO855P | | | | 0.92 | |
| PRO10R | | | | | 1.33 |
| PRO20R | | | | | 2.41 |
| SKN287S | 5.46 | 0.65 | | | |
| SKN39A | 2.56 | 0.22 | | | |

-continued

| Sample ID | CAN | NAT | NRM | BPH | PROST |
|---|---|---|---|---|---|
| SKN669S | 6.12 | 9.44 | | | |
| SMINT171S | 1.39 | 0.62 | | | |
| SMINT20SM | 7.46 | 2.59 | | | |
| SMINTH89 | 0.97 | 0.16 | | | |
| STO261S | 4.97 | 3.16 | | | |
| STO288S | 0.23 | 0.40 | | | |
| STO88S | 3.10 | 0.38 | | | |
| THRD143N | 0.70 | 5.66 | | | |
| THRD270T | 11.59 | 12.76 | | | |
| THRD56T | 4.61 | 1.92 | | | |
| TST39X | 0.91 | 0.00 | | | |
| TST647T | 1.42 | 0.29 | | | |
| TST663T | 1.42 | 0.37 | | | |
| UTR135XO | 3.28 | 4.02 | | | |
| UTR85XU | 1.51 | 2.11 | | | |
| BLOB3 | | | 0.25 | | |
| BLOB11 | | | 0.92 | | |
| ADR48AD | | | 0.00 | | |
| BRN10BR | | | 0.00 | | |
| CLN01CL | | | 0.22 | | |
| ESO01ES | | | 7.88 | | |
| HRT46HR | | | 0.06 | | |
| HUMREF00HR | 0.49 | | | | |
| KID55KD | | | 0.10 | | |
| LVR89LV | | | 0.03 | | |
| LNG90LN | | | 0.26 | | |
| MAM01MA | | | 1.00 | | |
| MSL84MU | | | 0.06 | | |
| OVR3APV | | | 1.02 | | |
| PAN04PA | | | 0.14 | | |
| PLA59PL | | | 2.01 | | |
| PRO09PR | | | 0.57 | | |
| REC21RC | | | 1.21 | | |
| SMINT59SM | | | 0.11 | | |
| SPL7GSP | | | 0.26 | | |
| STO09ST | | | 1.56 | | |
| THYM99TM | | | 0.20 | | |
| TRA16TR | | | 1.45 | | |
| TST4GTS | | | 0.19 | | |
| UTR57UT | | | 1.28 | | |

0.00 = Negative or no expression

The sensitivity for Ovr107v4 expression was calculated for the cancer samples versus normal samples. The sensitivity value indicates the percentage of cancer samples that show levels of Ovr107v4 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr107v4 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 22% | 0% | 22% | 0% | 0% |
| Sensitivity, Down vs. NAT | 33% | 50% | 22% | 0% | 20% |
| Sensitivity, Up vs. NRM | 78% | 78% | 56% | 50% | 40% |
| Sensitivity, Down vs. NRM | 0% | 0% | 0% | 25% | 0% |
| Specificity | 8.05% | 8% | 13.79% | 13.17% | 7.95% |

Altogether, the tissue specificity, plus the mRNA differential expression in the samples tested are believed to make Ovr107v4 a good marker for diagnosing, monitoring, staging, imaging and/or treating ovarian cancer.

Primers used for QPCR Expression Analysis of Ovr107v4 are as follows:

(Ovr107v4_forward):   GGAGCCCTGAGCATTGTAATATG (SEQ ID NO: 335)

(Ovr107v4_reverse):   CCCTGGTAGCCGGGTAGAG (SEQ ID NO: 336)

(Ovr107v4_probe):   CAGATGGTGTGCCAACTGCTGT (SEQ ID NO: 337)

DEX0455_053.nt.2 (Ovr110v1)

The relative expression level of Ovr110v1 in various tissue samples is included below. Tissue samples include 74 pairs of matching samples, 111 non matched cancer samples, and 39 normal samples, all from various tissues annotated in the table. A matching pair is formed by mRNA from the cancer sample for a particular tissue and mRNA from the normal adjacent sample for that same tissue from the same individual. Of the normal samples 5 were blood samples which measured the expression levels in blood cells. Additionally, 2 prostatitis, and 4 Benign Prostatic Hyperplasia (BPH) samples are included. All the values are compared to breast normal sample MAM01MA (calibrator).

The table below contains the relative expression level values for the sample as compared to the calibrator. The table includes the Sample ID, and expression level values for the following samples: Cancer (CAN), Normal Adjacent Tissue (NAT), Normal Tissue (NRM), Benign Prostatic Hyperplasia (BPH), and Prostatitis (PROST).

| Sample ID | CAN | NAT | NRM | BPH | PROST |
|---|---|---|---|---|---|
| OVRA084 | 0.00 | 0.00 | | | |
| OVRG010 | 0.00 | 0.00 | | | |
| OVRG021 | 0.00 | 0.00 | | | |
| OVR1157 | 4.92 | | | | |
| OVR773O | 4.23 | | | | |
| OVRC360 | 0.00 | | | | |
| OVR1005O | 0.00 | | | | |
| OVR1040O | 0.11 | | | | |
| OVR105O | 0.00 | | | | |
| OVR130X | 0.00 | | | | |
| OVR718O | 0.33 | | | | |
| OVRA1B | 0.07 | | | | |
| OVR35GA | | | 0.00 | | |
| OVRC087 | | | 0.00 | | |
| OVRC109 | | | 0.00 | | |
| OVR206I | | | 0.00 | | |
| OVR515O | | | 0.00 | | |

-continued

| Sample ID | CAN | NAT | NRM | BPH | PROST |
|---|---|---|---|---|---|
| OVR18GA | | | 0.00 | | |
| OVR337O | | | 0.00 | | |
| OVR123O | | | 0.00 | | |
| OVRC177 | | | 0.00 | | |
| OVR40G | | | 0.00 | | |
| OVR451O | | | 0.00 | | |
| BLD030B | 0.00 | 0.53 | | | |
| BLD520B | 0.00 | 0.00 | | | |
| BLDTR17 | 0.00 | 0.03 | | | |
| CLN401C | 0.00 | 0.00 | | | |
| CLNAS43 | 0.00 | 0.00 | | | |
| CLNAS98 | 0.00 | 0.00 | | | |
| CLNCM12 | 0.00 | 0.00 | | | |
| CLNDC19 | 0.00 | 0.00 | | | |
| CLNRC01 | 0.00 | 0.00 | | | |
| CLNRS53 | 0.00 | 0.00 | | | |
| CLNSG27 | 0.00 | 0.00 | | | |
| CLNTX01 | 0.00 | 0.00 | | | |
| CVXKS52 | 0.00 | 0.00 | | | |
| CVXNKS55 | 0.03 | 0.00 | | | |
| CVXNKS25 | 0.00 | 0.29 | | | |
| CVXNKS18 | 0.00 | 0.00 | | | |
| CVXNKS54 | 0.00 | 0.00 | | | |
| ENDO10479 | 0.10 | 0.00 | | | |
| ENDO28XA | 0.78 | 0.00 | | | |
| ENDO8XA | 0.00 | 0.01 | | | |
| KID106XD | 0.00 | 0.00 | | | |
| KID12XD | 0.01 | 0.15 | | | |
| KID10XD | 0.00 | 0.00 | | | |
| KID22K | 0.00 | 0.01 | | | |
| KID107XD | 0.00 | 0.01 | | | |
| LNG205L | 0.00 | 0.00 | | | |
| LNG315L | 0.00 | 0.00 | | | |
| LNG507L | 0.00 | 0.00 | | | |
| LNG528L | 0.00 | 0.00 | | | |
| LNG8837L | 0.21 | 0.00 | | | |
| LNGAC11 | 0.01 | 0.00 | | | |
| LNGAC39 | 0.00 | 0.00 | | | |
| LNGSQ80 | 0.00 | 0.00 | | | |
| LNGSQ81 | 0.08 | 0.00 | | | |
| LVR15XA | 0.00 | 0.00 | | | |
| LVR174L | 0.00 | 0.00 | | | |
| LVR187L | 0.00 | 0.03 | | | |
| MAM19DN | 0.36 | 1.23 | | | |
| MAM42DN | 0.09 | 0.00 | | | |
| MAM517 | 0.00 | 0.00 | | | |
| MAM781M | 0.47 | 0.00 | | | |
| MAM869M | 0.46 | 0.00 | | | |
| MAM976M | 0.22 | 0.00 | | | |
| MAMS570 | 0.55 | 0.45 | | | |
| MAMS699 | 0.22 | 1.06 | | | |
| MAMS997 | 0.73 | 0.21 | | | |
| PAN71XL | 0.00 | 0.00 | | | |
| PAN77X | 0.00 | | | | |
| PAN92X | 0.00 | 0.00 | | | |
| PRO10R | | | | | 0.00 |
| PRO20R | | | | | 0.00 |
| PRO23B | 0.00 | 0.00 | | | |
| PRO263C | | | | 0.00 | |
| PRO276P | | | | | 0.01 |
| PRO65XB | 0.01 | 0.01 | | | |
| PRO675P | 0.00 | 0.00 | | | |
| PRO767B | | | | 0.35 | |
| PRO84XB | 0.00 | 0.08 | | | |
| PRO855P | | | | | 0.00 |
| PRO958P | 0.03 | 0.03 | | | |
| SKN287S | 0.00 | 0.00 | | | |
| SKN39A | 0.00 | 0.00 | | | |
| SKN669S | 0.00 | 0.00 | | | |
| SMINT171S | 0.00 | 0.00 | | | |
| SMINT20SM | 0.00 | 0.00 | | | |
| SMINTH89 | 0.00 | 0.00 | | | |
| STO261S | 0.00 | 0.00 | | | |
| STO288S | 0.00 | 0.00 | | | |
| STOAC93 | 0.00 | 0.00 | | | |
| STO88S | 0.00 | 0.00 | | | |
| THRD143N | 0.00 | 0.00 | | | |
| THRD270T | 0.00 | 0.00 | | | |
| THRD56T | 0.00 | 0.00 | | | |
| TST39X | 0.84 | 0.00 | | | |
| TST647T | 0.00 | 0.00 | | | |
| TST663T | 0.04 | 0.00 | | | |
| UTR135XO | 0.00 | 0.00 | | | |
| UTR85XU | 0.00 | 0.03 | | | |
| BLOB3 | | | 0.00 | | |
| BLOB11 | | | 0.00 | | |
| BLO69 | | | 0.00 | | |
| BLO72 | | | 0.00 | | |
| BLO73 | | | 0.00 | | |
| ADR48AD | | | 0.00 | | |
| BRN10BR | | | 0.00 | | |
| CLN01CL | | | 0.00 | | |
| CVX06CV | | | 0.00 | | |
| ESO01ES | | | 0.00 | | |
| HRT46HR | | | 0.00 | | |
| HUMREF00HR | | 0.00 | | | |
| KID55KD | | | 0.00 | | |
| LVR89LV | | | 0.00 | | |
| LNG90LN | | | 0.00 | | |
| MAM01MA | | | 1.00 | | |
| MSL84MU | | | 0.00 | | |
| OVR3APV | | | 0.00 | | |
| PAN04PA | | | 0.00 | | |
| PLA59PL | | | 0.00 | | |
| PRO09PR | | | 0.51 | | |
| REC21RC | | | 0.00 | | |
| SMINT59SM | | | 0.00 | | |
| SPL7GSP | | | 0.00 | | |
| STO09ST | | | 0.00 | | |
| THYM99TM | | | 0.00 | | |
| TRA16TR | | | 0.15 | | |
| TST4GTS | | | 0.15 | | |
| UTR57UT | | | 0.00 | | |

0.00 = Negative or no expression

The sensitivity for Ovr110v1 expression was calculated for the cancer samples versus normal samples. The sensitivity value indicates the percentage of cancer samples that show levels of Ovr110v1 at least 2 fold higher than the normal tissue or the corresponding normal adjacent form the same patient.

This specificity is an indication of the level of ovary tissue specific expression of the transcript compared to all the other tissue types tested in our assay. Thus, these experiments indicate Ovr110v1 being useful as an ovarian cancer diagnostic marker and/or therapeutic target.

Sensitivity and specificity data is reported in the table below.

| | CLN | LNG | MAM | OVR | PRO |
|---|---|---|---|---|---|
| Sensitivity, Up vs. NAT | 0% | 33% | 56% | 0% | 0% |
| Sensitivity, Down vs. NAT | 0% | 0% | 22% | 0% | 20% |
| Sensitivity, Up vs. NRM | 0% | 33% | 0% | 42% | 0% |
| Sensitivity, Down vs. NRM | 0% | 0% | 78% | 0% | 100% |
| Specificity | 74.73% | 76.34% | 89.78% | 76.27% | 79.26% |

Altogether, the tissue specificity, plus the mRNA differential expression in the samples tested are believed to make Ovr110v1 a good marker for diagnosing, monitoring, staging, imaging and/or treating ovarian cancer.

Additionally, the tissue specificity, plus the mRNA differential expression in the samples tested may make Ovr110v1 a good marker for diagnosing, monitoring, staging, imaging and/or treating lung cancer.

Primers used for QPCR Expression Analysis of Ovr110v1 are as follows:

```
                        (SEQ ID NO: 338)
(Ovr110v1_forward):  TCATTGGCTTTGGTATTTCAGAAG (SEQ ID NO: 339)
(Ovr110v1_reverse):  GTTCAGGAAGCAAAGATCAATGC (SEQ ID NO: 340)
(Ovr110v1_probe):    AGCAATGAAGGGTTTGGTTGTAGAAG
```

Conclusions

Altogether, the high level of tissue specificity, plus the mRNA overexpression in matched samples tested are indicative of SEQ ID NO: 1-128 being a diagnostic marker and/or a therapeutic target for cancer.

Example 3

Protein Expression

The OSNA is amplified by polymerase chain reaction (PCR) and the amplified DNA fragment encoding the OSNA is subcloned in pET-21d for expression in *E. coli*. In addition to the OSNA coding sequence, codons for two amino acids, Met-Ala, flanking the $NH_2$-terminus of the coding sequence of OSNA, and six histidines, flanking the COOH-terminus of the coding sequence of OSNA, are incorporated to serve as initiating Met/restriction site and purification tag, respectively.

An over-expressed protein band of the appropriate molecular weight may be observed on a Coomassie blue stained polyacrylamide gel. This protein band is confirmed by Western blot analysis using monoclonal antibody against 6× Histidine tag.

Large-scale purification of OSP is achieved using cell paste generated from 6-liter bacterial cultures, and purified using immobilized metal affinity chromatography (IMAC). Soluble fractions that are separated from total cell lysate were incubated with a nickel chelating resin. The column is packed and washed with five column volumes of wash buffer. OSP is eluted stepwise with various concentration imidazole buffers.

Example 4

Fusion Proteins

The human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector. For example, if pC4 (Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 2, is ligated into this BamHI site. Note that the polynucleotide is cloned without a stop codon, otherwise a fusion protein will not be produced. If the naturally occurring signal sequence is used to produce the secreted protein, pC4 does not need a second signal peptide. Alternatively, if the naturally occurring signal sequence is not used, the vector can be modified to include a heterologous signal sequence. See, e.g., WO 96/34891.

Example 5

Production of an Antibody from a Polypeptide

In general, such procedures involve immunizing an animal (preferably a mouse) with polypeptide or, more preferably, with a secreted polypeptide-expressing cell. Such cells may be cultured in any suitable tissue culture medium; however, it is preferable to culture cells in Earle's modified Eagle's medium supplemented with 10% fetal bovine serum (inactivated at about 56° C.), and supplemented with about 10 g/l of nonessential amino acids, about 1,000 U/ml of penicillin, and about 100, μg/ml of streptomycin. The splenocytes of such mice are extracted and fused with a suitable myeloma cell line. Any suitable myeloma cell line may be employed in accordance with the present invention; however, it is preferable to employ the parent myeloma cell line (SP20), available from the ATCC. After fusion, the resulting hybridoma cells are selectively maintained in HAT medium, and then cloned by limiting dilution as described by Wands et al., *Gastroenterology* 80: 225-232 (1981).

The hybridoma cells obtained through such a selection are then assayed to identify clones which secrete antibodies capable of binding the polypeptide. Alternatively, additional antibodies capable of binding to the polypeptide can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the protein-specific antibody can be blocked by the polypeptide. Such antibodies comprise anti-idiotypic antibodies to the protein specific antibody and can be used to immunize an animal to induce formation of further protein-specific antibodies.

Example 6

Method of Determining Alterations in a Gene Corresponding to a Polynucleotide

RNA is isolated from individual patients or from a family of individuals that have a phenotype of interest. cDNA is then generated from these RNA samples using protocols known in the art. See, Sambrook (2001), supra. The cDNA is then used as a template for PCR, employing primers surrounding regions of interest in SEQ ID NO: 1-128. Suggested PCR conditions consist of 35 cycles at 95° C. for 30 seconds; 60-120 seconds at 52-58° C.; and 60-120 seconds at 70° C., using buffer solutions described in Sidransky et al., *Science* 252(5006): 706-9 (1991). See also Sidransky et al., *Science* 278(5340): 1054-9 (1997).

PCR products are then sequenced using primers labeled at their 5' end with T4 polynucleotide kinase, employing SequiTherm Polymerase. (Epicentre Technologies). The intron-exon borders of selected exons are also determined and genomic PCR products analyzed to confirm the results. PCR products harboring suspected mutations are then cloned and sequenced to validate the results of the direct sequencing. PCR products is cloned into T-tailed vectors as described in Holton et al., *Nucleic Acids Res.*, 19: 1156 (1991) and sequenced with T7 polymerase (United States Biochemical). Affected individuals are identified by mutations not present in unaffected individuals.

Genomic rearrangements may also be determined. Genomic clones are nick-translated with digoxigenin deoxyuridine 5' triphosphate (Boehringer Manheim), and FISH is performed as described in Johnson et al., *Methods Cell Biol.* 35: 73-99 (1991). Hybridization with the labeled probe is carried out using a vast excess of human cot-1 DNA for specific hybridization to the corresponding genomic locus.

Chromosomes are counterstained with 4,6-diamino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. Johnson (1991). Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 7

Method of Detecting Abnormal Levels of a Polypeptide in a Biological Sample

Antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described above. The wells are blocked so that non-specific binding of the polypeptide to the well is reduced. The coated wells are then incubated for >2 hours at RT with a sample containing the polypeptide. Preferably, serial dilutions of the sample should be used to validate results. The plates are then washed three times with deionized or distilled water to remove unbound polypeptide. Next, 50 µl of specific antibody-alkaline phosphatase conjugate, at a concentration of 25-400 ng, is added and incubated for 2 hours at room temperature. The plates are again washed three times with deionized or distilled water to remove unbound conjugate. 75 µl of 4-methylumbelliferyl phosphate (MUP) or p-nitrophenyl phosphate (NPP) substrate solution are added to each well and incubated 1 hour at room temperature.

The reaction is measured by a microtiter plate reader. A standard curve is prepared, using serial dilutions of a control sample, and polypeptide concentrations are plotted on the X-axis (log scale) and fluorescence or absorbance on the Y-axis (linear scale). The concentration of the polypeptide in the sample is calculated using the standard curve.

Example 8

Formulating a Polypeptide

The secreted polypeptide composition will be formulated and dosed in a fashion consistent with good medical practice, taking into account the clinical condition of the individual patient (especially the side effects of treatment with the secreted polypeptide alone), the site of delivery, the method of administration, the scheduling of administration, and other factors known to practitioners. The "effective amount" for purposes herein is thus determined by such considerations.

As a general proposition, the total pharmaceutically effective amount of secreted polypeptide administered parenterally per dose will be in the range of about 1, µg/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the secreted polypeptide is typically administered at a dose rate of about 1 dg/kg/hour to about 50 mg/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect.

Pharmaceutical compositions containing the secreted protein of the invention are administered orally, rectally, parenterally, intracisternally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The secreted polypeptide is also suitably administered by sustained-release systems. Suitable examples of sustained-release compositions include semipermeable polymer matrices in the form of shaped articles, e.g., films, or microcapsules. Sustained-release matrices include polylactides (U.S. Pat. No. 3,773,919, EP 58,481, the contents of which are hereby incorporated by reference herein in their entirety), copolymers of L-glutamic acid and gamma-ethyl-L-glutamate (Sidman, U. et al., Biopolymers 22: 547-556 (1983)), poly (2-hydroxyethyl methacrylate) (R. Langer et al., J. Biomed. Mater. Res. 15: 167-277 (1981), and R. Langer, Chem. Tech. 12: 98-105 (1982)), ethylene vinyl acetate (R. Langer et al.) or poly-D-(−)-3-hydroxybutyric acid (EP 133,988). Sustained-release compositions also include liposomally entrapped polypeptides. Liposomes containing the secreted polypeptide are prepared by methods known per se: D E Epstein et al., Proc. Natl. Acad. Sci. USA 82: 3688-3692 (1985); Hwang et al., Proc. Natl. Acad. Sci. USA 77: 4030-4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324, the contents of which are hereby incorporated by reference herein in their entirety. Ordinarily, the liposomes are of the small (about 200-800 Angstroms) unilamellar type in which the lipid content is greater than about 30 mol. percent cholesterol, the selected proportion being adjusted for the optimal secreted polypeptide therapy.

For parenteral administration, in one embodiment, the secreted polypeptide is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation.

For example, the formulation preferably does not include oxidizing agents and other compounds that are known to be deleterious to polypeptides. Generally, the formulations are prepared by contacting the polypeptide uniformly and intimately with liquid carriers or finely divided solid carriers or both. Then, if necessary, the product is shaped into the desired formulation. Preferably, the carrier is a parenteral carrier, more preferably, a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The secreted polypeptide is typically formulated in such vehicles at a concentration of about 0.1 mg/ml to 100 mg/ml, preferably 1-10 mg/ml, at a pH of about 3 to 8. It will be understood that the use of certain of the foregoing excipients, carriers, or stabilizers will result in the formation of polypeptide salts.

Any polypeptide to be used for therapeutic administration can be sterile. Sterility is readily accomplished by filtration through sterile filtration membranes (e.g., 0.2 micron membranes). Therapeutic polypeptide compositions generally are placed into a container having a sterile access port, for example, an intravenous solution bag or vial having a stopper pierceable by a hypodermic injection needle.

Polypeptides ordinarily will be stored in unit or multi-dose containers, for example, sealed ampules or vials, as an aqueous solution or as a lyophilized formulation for reconstitution. As an example of a lyophilized formulation, 10-ml vials are filled with 5 ml of sterile-filtered 1% (w/v) aqueous polypeptide solution, and the resulting mixture is lyophilized. The infusion solution is prepared by reconstituting the lyophilized polypeptide using bacteriostatic Water-for-Injection.

The invention also provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the polypeptides of the present invention may be employed in conjunction with other therapeutic compounds.

Example 9

Method of Treating Decreased Levels of the Polypeptide

It will be appreciated that conditions caused by a decrease in the standard or normal expression level of a secreted protein in an individual can be treated by administering the polypeptide of the present invention, preferably in the secreted form. Thus, the invention also provides a method of treatment of an individual in need of an increased level of the polypeptide comprising administering to such an individual a pharmaceutical composition comprising an amount of the polypeptide to increase the activity level of the polypeptide in such an individual.

For example, a patient with decreased levels of a polypeptide receives a daily dose 0.1-100 ug/kg of the polypeptide for six consecutive days. Preferably, the polypeptide is in the secreted form. The exact details of the dosing scheme, based on administration and formulation, are provided above.

Example 10

Method of Treating Increased Levels of the Polypeptide

Antisense or RNAi technology are used to inhibit production of a polypeptide of the present invention. This technology is one example of a method of decreasing levels of a polypeptide, preferably a secreted form, due to a variety of etiologies, such as cancer.

For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The formulation of the antisense polynucleotide is provided above.

Example 11

Method of Treatment Using Gene Therapy

One method of gene therapy transplants fibroblasts, which are capable of expressing a polypeptide, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37° C. for approximately one week.

At this time, fresh media is added and subsequently changed every several days. After an additional two weeks in culture, a monolayer of fibroblasts emerge. The monolayer is trypsinized and scaled into larger flasks. pMV-7 (Kirschmeier, P. T. et al., DNA, 7: 219-25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 3. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB 101, which are then plated onto agar containing kanamycin for the purpose of confirming that the vector has the gene of interest properly inserted.

The amphotropic pA317 or GP+aml2 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media.

If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

Example 12

Method of Treatment Using Gene Therapy-In Vivo

Another aspect of the present invention is using in vivo gene therapy methods to treat disorders, diseases and conditions. The gene therapy method relates to the introduction of naked nucleic acid (DNA, RNA, and antisense DNA or RNA) sequences into an animal to increase or decrease the expression of the polypeptide.

The polynucleotide of the present invention may be operatively linked to a promoter or any other genetic elements necessary for the expression of the polypeptide by the target tissue. Such gene therapy and delivery techniques and methods are known in the art, see, for example, Tabata H. et al. *Cardiovasc. Res.* 35 (3): 470-479 (1997); Chao J et al. *Pharmacol. Res.* 35 (6): 517-522 (1997); Wolff J. A. *Neuromuscul. Disord.* 7 (5): 314-318 (1997), Schwartz B. et al. *Gene Ther.* 3 (5): 405-411 (1996); and Tsurumi Y. et al. *Circulation* 94 (12): 3281-3290 (1996); WO 90/11092, WO 98/11779; U.S. Pat. Nos. 5,693,622; 5,705,151; 5,580,859, the contents of which are hereby incorporated by reference herein in their entirety.

The polynucleotide constructs may be delivered by any method that delivers injectable materials to the cells of an animal, such as, injection into the interstitial space of tissues (heart, muscle, skin, ovarian, liver, intestine and the like). The polynucleotide constructs can be delivered in a pharmaceutically acceptable liquid or aqueous carrier.

The term "naked" polynucleotide, DNA or RNA, refers to sequences that are free from any delivery vehicle that acts to assist, promote, or facilitate entry into the cell, including viral sequences, viral particles, liposome formulations, lipofectin or precipitating agents and the like. However, the polynucleotides of the present invention may also be delivered in liposome formulations (such as those taught in Felgner P. L. et al.

*Ann. NY Acad. Sci.* 772: 126-139 (1995) and Abdallah B. et al. *Biol. Cell* 85 (1): 1-7 (1995)) which can be prepared by methods well known to those skilled in the art.

The polynucleotide vector constructs used in the gene therapy method are preferably constructs that will not integrate into the host genome nor will they contain sequences that allow for replication. Any strong promoter known to those skilled in the art can be used for driving the expression of DNA. Unlike other gene therapies techniques, one major advantage of introducing naked nucleic acid sequences into target cells is the transitory nature of the polynucleotide synthesis in the cells. Studies have shown that non-replicating DNA sequences can be introduced into cells to provide production of the desired polypeptide for periods of up to six months.

The polynucleotide construct can be delivered to the interstitial space of tissues within the an animal, including of muscle, skin, brain, ovarian, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked polynucleotide injection, an effective dosage amount of DNA or RNA will be in the range of from about 0.05 µg/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration. The preferred route of administration is by the parenteral route of injection into the interstitial space of tissues. However, other parenteral routes may also be used, such as, inhalation of an aerosol formulation particularly for delivery to ovarians or bronchial tissues, throat or mucous membranes of the nose. In addition, naked polynucleotide constructs can be delivered to arteries during angioplasty by the catheter used in the procedure.

The dose response effects of injected polynucleotide in muscle in vivo is determined as follows. Suitable template DNA for production of mRNA coding for polypeptide of the present invention is prepared in accordance with a standard recombinant DNA methodology. The template DNA, which may be either circular or linear, is either used as naked DNA or complexed with liposomes. The quadriceps muscles of mice are then injected with various amounts of the template DNA.

Five to six week old female and male Balb/C mice are anesthetized by intraperitoneal injection with 0.3 ml of 2.5%

Avertin. A 1.5 cm incision is made on the anterior thigh, and the quadriceps muscle is directly visualized. The template DNA is injected in 0.1 ml of carrier in a 1 cc syringe through a 27 gauge needle over one minute, approximately 0.5 cm from the distal insertion site of the muscle into the knee and about 0.2 cm deep. A suture is placed over the injection site for future localization, and the skin is closed with stainless steel clips.

After an appropriate incubation time (e.g., 7 days) muscle extracts are prepared by excising the entire quadriceps. Every fifth 15 um cross-section of the individual quadriceps muscles is histochemically stained for protein expression. A time course for protein expression may be done in a similar fashion except that quadriceps from different mice are harvested at different times. Persistence of DNA in muscle following injection may be determined by Southern blot analysis after preparing total cellular DNA and HIRT supernatants from injected and control mice.

The results of the above experimentation in mice can be use to extrapolate proper dosages and other treatment parameters in humans and other animals using naked DNA.

Example 13

Transgenic Animals

The polypeptides of the invention can also be expressed in transgenic animals. Animals of any species, including, but not limited to, mice, rats, rabbits, hamsters, guinea pigs, pigs, micro-pigs, goats, sheep, cows and non-human primates, e.g., baboons, monkeys, and chimpanzees may be used to generate transgenic animals. In a specific embodiment, techniques described herein or otherwise known in the art, are used to express polypeptides of the invention in humans, as part of a gene therapy protocol.

Any technique known in the art may be used to introduce the transgene (I. e., polynucleotides of the invention) into animals to produce the founder lines of transgenic animals. Such techniques include, but are not limited to, pronuclear microinjection (Paterson et al., *Appl. Microbiol. Biotechnol.* 40: 691-698 (1994); Carver et al., *Biotechnology* 11: 1263-1270 (1993); Wright et al., *Biotechnology* 9: 830-834 (1991); and U.S. Pat. No. 4,873,191, the contents of which is hereby incorporated by reference herein in its entirety); retrovirus mediated gene transfer into germ lines (Van der Putten et al., *Proc. Natl. Acad. Sci., USA* 82: 6148-6152 (1985)), blastocysts or embryos; gene targeting in embryonic stem cells (Thompson et al., *Cell* 56: 313-321 (1989)); electroporation of cells or embryos (Lo, 1983, *Mol. Cell. Biol.* 3: 1803-1814 (1983)); introduction of the polynucleotides of the invention using a gene gun (see, e.g., Ulmer et al., *Science* 259: 1745 (1993); introducing nucleic acid constructs into embryonic pleuripotent stem cells and transferring the stem cells back into the blastocyst; and sperm mediated gene transfer (Lavitrano et al., *Cell* 57: 717-723 (1989). For a review of such techniques, see Gordon, "Transgenic Animals," *Intl. Rev. Cytol.* 115: 171-229 (1989).

Any technique known in the art may be used to produce transgenic clones containing polynucleotides of the invention, for example, nuclear transfer into enucleated oocytes of nuclei from cultured embryonic, fetal, or adult cells induced to quiescence (Campell et al., *Nature* 380: 64-66 (1996); Wilmut et al., *Nature* 385: 810813 (1997)).

The present invention provides for transgenic animals that carry the transgene in all their cells, as well as animals which carry the transgene in some, but not all their cells, I. e., mosaic animals or chimeric. The transgene may be integrated as a single transgene or as multiple copies such as in concatamers, e.g., head-to-head tandems or head-to-tail tandems. The transgene may also be selectively introduced into and activated in a particular cell type by following, for example, the teaching of Lasko et al. (Lasko et al., *Proc. Natl. Acad. Sci. USA* 89: 6232-6236 (1992)). The regulatory sequences required for such a cell-type specific activation will depend upon the particular cell type of interest, and will be apparent to those of skill in the art. When it is desired that the polynucleotide transgene be integrated into the chromosomal site of the endogenous gene, gene targeting is preferred. Briefly, when such a technique is to be utilized, vectors containing some nucleotide sequences homologous to the endogenous gene are designed for the purpose of integrating, via homologous recombination with chromosomal sequences, into and disrupting the function of the nucleotide sequence of the endogenous gene. The transgene may also be selectively introduced into a particular cell type, thus inactivating the endogenous gene in only that cell type, by following, for example, the teaching of Gu et al. (Gu et al., *Science* 265: 103-106 (1994)). The regulatory sequences required for such a cell-type specific inactivation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (rt-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Example 14

Knock-Out Animals

Endogenous gene expression can also be reduced by inactivating or "knocking out" the gene and/or its promoter using targeted homologous recombination. (E. g., see Smithies et al., Nature 317: 230-234 (1985); Thomas & Capecchi, Cell 51: 503512 (1987); Thompson et al., Cell 5: 313-321 (1989)) Alternatively, RNAi technology may be used. For example, a mutant, non-functional polynucleotide of the invention (or a completely unrelated DNA sequence) flanked by DNA homologous to the endogenous polynucleotide sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene (e.g., see Thomas & Capecchi 1987 and Thompson 1989, supra). However, this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from the patient (i.e., animal, including human) or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc.

The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft. (See, for example, Anderson et al. U.S. Pat. No. 5,399,349; and Mulligan & Wilson, U.S. Pat. No. 5,460,959, the contents of which are hereby incorporated by reference herein in their entirety).

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

While preferred illustrative embodiments of the present invention are described, one skilled in the art will appreciate that the present invention can be practiced by other than the described embodiments, which are presented for purposes of illustration only and not by way of limitation. The present invention is limited only by the claims that follow.

SEQUENCE LISTING (340 sequences)

SEQ ID NO: 1 - DNA, 4798 bp, Homo sapien
ggsasgwggccaaggcatctgccactgctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcagaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaa

SEQ ID NO: 2 - DNA, 1494 bp, Homo sapien
aggcgccgaggccctcctgtgcctgtcactggcaataatccatgccacagaagactatttgctttccctgggcctaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacatt

SEQ ID NO: 3 - DNA, 1691 bp, Homo sapien
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctactgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtatttgggccgggcgcaggggctcacgcctgtaatccgcgcacttggagaggccgaggtgggtggatcacttgaggtcagcaattagagaccagtctggccaacatggtgaaaccccgtctctactaaaaatacaaaattagcctggcatggtggcgggcgcctgtaattccagctacctgggaggctgaggcacgagaatcccttgaacctgggaggtggaggttgtgatgagccgagatcacaccactgcactccagcctgtgtgactgagtgagactctgtctcaacaacaacaaagaagaatgtattttaatttaacagttcactaaaaagtttattcatcagttatgcagaaaagaaaggcttaatgagactccttcgtctgagaggggaataaacactttgtcact

SEQ ID NO: 4 - DNA, 8772 bp, Homo sapien
accaaactgaagtgtaaggataagacctctcctgctgctagtactaggagaggtcttatccttacacttcagtttggtcaccagattatgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcmgggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagtattttgaaatctgagatctaattcctggccgggcgcggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttacttttttttctctcttttttttattctgtgttcaggtatcatttgaccaacaacttgctcttaatcttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctgtctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtagaaaaaaaacaaaaaaaaaaaaatttkgggggccggcgccaagaagtttcaaccacatgtgtggggccggcccaggtgaaggaaatggcaagtggccaagaaccggccagaaggggggtttcccaaaaaacgcgcgggcgcgcgtttga

SEQ ID NO: 5 - DNA, 7616 bp, Homo sapien
ttctggtggcaaaactagaatcacgactacccccccttcagaggactccatttaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcmgggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagtattttgaaatctgagatctaattcctggccgggcgcggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttacttttttttctctcttttttttattctgtgttcaggtatcatttgaccaacaacttgctcttaatcttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctgtctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtagaaaaaaaacaaaaaaaaaaaaatttkgggggccggcgccaagaagtttcaaccacatgtgtggggccggcccaggtgaaggaaatggcaagtggccaagaaccggccagaaggggggtttcccaaaaaacgcgcgggcgcgcgtttga

SEQ ID NO: 6 - DNA, 1921 bp, Homo sapien
gacctctcctcatctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcgggtgagcaagatacgcccccaatgttagctaatgatgtaaggcatcaacaagaaatgtgggggttcaggaaagtggaaggtggggtcgtccaaagcctgggaaagtcttcagttgaaggcgagacagatgggactattagtgagtttcgagagatccaacgcctcgccgccttcgcttcatttttgtctcacgccccacccttgaacgcgcggcgccttttgaccccgccgccgcgccgtagaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatcaaaaaaaaaaaaaaaaacaaaaaaaaaaaaaaggaaaaaagaaaaaaaaaaaaaaaaagaaacaagacaaaaacagagagcggcaaaaaaagaacacagagaggagacacacaaagacgaacaaaccacgagaaagagcgaccaagaagcgcacaaaaaaaagaaaagaggaggcacagaaacaaccgcgaggaaaaagaacaacagcagaccgagagcgcccggagcgggaaaacacacacgaagtgaggacagagaagacgacagccggacacaaacaaaaagaaaggaaaagagacacgagcggagggcgacacaaaaaacaaaagacagaacaaacgacgcgaagacacccgagacaaaagcgaccaggagagagaagcgaacgagcgcccaccccgacaacacaagacaaga

SEQ ID NO: 7 - DNA, 1469 bp, Homo sapien
gacctctcctcatctgtgcatggatgagtggccgactttggagcccaggctgttacttcctggtctggtggtgaatcctccatagtctgagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcgggtgagcaagatacgcccccaatgttagctaatgatgtaaggcatcaacaagaaatgtgggggttcaggaaagtggaaggtggggtcgtccaaagcctgggaaagtcttcagttgaaggcgagacagatgggactattagtgagtttcgagagatccaacgcctcgccgccttcgcttcatttttgtctcacgccccacccttgaacgcgcggcgccttttgaccccgccgccgcgccgtagaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatc

SEQ ID NO: 8 - DNA, 1268 bp, Homo sapien
ttcctggtggtgatggtgtgcacttttattcaactggtctcaagtcagtgtacaggtaagccctggctgcctccacccactcccagggagaccaaaagccttcatacatctcaagttggaggacaaaggaagggagaggggtggagggacagaaaggaagaggaaggatggaggaaggaaaaaggaggagaagcaaacggggggggctgcccttgcctctgagaacctgctacactgtctcctttggtagcagcctgcccctgtgcctctaacctacacgtgacttgggtcaaataaaacttccaggaggatccaaacctgaaggacagtgggaaccccagaatgcactttgaggcttctctagcagtggacgagcgcctgtcttcttagtccctgaccctggatctttctgaaggtctcctcatcacccagctgccagggaacctggctgcccctgaagcagctcacactggtctgtcccctctgcagcaccacccatgctgcccctcagctcttcccgctgctctcactcctgaacacttaaggagatggcaggggaggagctgccgaaccagaggagcaccccacacactgccaacagggcttgacccaggagcgggggcttgaaaagctccagctccgtttttagaggaagaagaatgccggattacaacacagcaccagcaatctggatattcgttccctggctgttctttaaccagccaggaaatgccctgtgcaagggctggaggcctggggctgcagactcccaatctcaatgggcaccccagggctgagccacctgagggcactgggggtttccattttcaaacgggaatcctagcagcttccctgctcccacctgcggaagaggagacacttttgtacattctgactttctgcagacaggtaaaaaggcgtacacagacctttggggatgaaagagaaactaaaactgaaccaagtgtacaggttacagcgtcacagtcaaggcacctaacagaccctacttactgtttgttcttaaacatgaatgactgcagatccctgccagagacggtaagtgaaaaaacagctacctcctattttctttacgtatttcccatcaaacgcctgtcttgggttgggttaagaattacagaaggtaaacggagtcaattccaagtcactcaagcaattttctgtgtgaagagagaacaagacaaaagccaaccacaacagcaaaacccaaagcctccgttacgccttctatggcaatcaaacacgcc

SEQ ID NO: 9 - DNA, 1328 bp, Homo sapien
ataagtgtcttaacttgggctgtcttcactccacccctcccgagtaggtacttcagttgtgcccattctacagacagggaagctgaggctggagaggtcaggactcgcctgaggtcctacggtctcccctgggacctggctgaggatgggggccgggctgggccctcagggttggagactctgaccccctactccccgacccccagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcctgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgacctccgtggggcggtgccctgcccctgccccccgcccaccgcctccgctatctgtccccagcccgaaggcggttcggtggggatgctacattcaaacttcaagagcccagaggcgtcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttgggtgtggtggcgcacgcctgtggtcccagctacgcaggaggctgaggtgggaggatccctcgagctcaggaggtggaggcagcagtgagccaagatcatgcccttgcactccagcctgggcaacacagtgagaggccatctcttta

SEQ ID NO: 10 - DNA, 2061 bp, Homo sapien
cccttttcaatgaaaagtcactgagcttggtgagtcaagattcactgaaatattcttccatgttgatgggcctctttggtgaggtgaccttattcctgtcctgccccctaagggtgggcagggtggacagaacgcagcctggacttccggacgcagccccctaccgccccggactcgcctacccctctggcctctgaggagggccctaagcccaggacagacgtggaaaaagggcagtaaaaaggatgcagttcttctctttaatccctaacccaatttctcgggaaaagctgcgttcccacacagaaggcgaaccctgtaaagctgtggcttggctgccgcgcacgcagtcgctttacgaattcccaaagcatctagcggaagtttagaccgttcactaggggtcacatgggccacttcgcgagcagctggcgaacagttcctttcagtttgaaagtatctttgaaactcggaaattgtgctccttggtctttcagttcataagcctagagagtggctactgaaattggaatcgtcatcttcttccctcggccccaactagtagaccacgaccagaagacacatcctaacctacacctaccgtagtgtcacacccggcacagcgcgaccaggtccaccaactgcgcctgcgcgaaccggccgctcccgcgacatcacaggaaggctgagagaaagggcaggtccccgctgcgtggggctgggcttaaaggctcgtcgcgcctgcgcaaaggacctgacgacgtgctgcgtcgttacttttgaaacgcttggcggggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaa

SEQ ID NO: 11 - DNA, 1826 bp, Homo sapien
tcgaaymgtaaccgttcgtacgagaatcgctgtcctctccttgcggccgcagtgtggtggaattcttttccgacacgtagtagtactgacgcttgggaacggcctgggccagaatctcgatctggcgagcgttcaggcccatgcggcggtacagggccgccgtgtcctcatccctggcgtaaatattcggcaggaaaatcttggtcgcggtcgattccacgatcacgtccaggatgccgctgttggcggcgtcggacaggctctgcgttgccatcagcacaaggcagttggccttacgcagcaccttgagccattccctgatcttcgcgcggaatgccgggtggccgagcatcaaccaggcttcgtccaggatgatgacggccgccagtgtggtggaattctaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 12 - DNA, 1106 bp, Homo sapien
ataatttggaatgtgggtggagaggggatcatagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcttgtggcaggataagtatgagtgtcatttcttcaacgggacggagcgggtgcggttcctggaaagagtcatctataaccaagaggagttcgtgcgcttcgacagcgacgtgggggagtaccgggcggtgacggagctagggcggcctgtcgccgatccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatgga

SEQ ID NO: 13 - DNA, 943 bp, Homo sapien
ataatttggaatgtgggtggagaggggatcatagttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaactccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatgga

SEQ ID NO: 14 - DNA, 487 bp, Homo sapien
ggattcagaggtccagcccactggcctcttcccactggactccatctgactcccccatccctctctgtccccagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgaaaaaaaa

SEQ ID NO: 15 - DNA, 3870 bp, Homo sapien
catccaatgagacaccagctcaggttactgcaggggacacactataaagccctgagctcagggaggagctccctccaggctctatatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcggtgagtcgagggaggtccccaagagggcgtcccatttagcaatgcacagggggcccggctcttcctgcagccttttcctgtagaggggctactctccctaactcccctcttgcccctccttgaccttccaccaccgtccccacagatggttttcgtgactgcaagaagggggatcccaagcacgggaagcggaaacgaggccggccccgaaagctgagcaaagagtactgggactgtctcgagggcaagaagagcaagcacggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaattgcagagcctggcttggtggtcctggagaggaggaggaaataaggctcccagtgggaggctcatggtaccagagtcctgtccactgactccagtgtcctgtccactgactccagttctctctgcacttggccactgtcctgccctctgggacaccctcaatgtgaggaggcagctggtgggtcttaggtgggctgaggagaaaagcagtcactgcagtacccgcacagagggcactgcggggtctctggagaggcttgctgcatgctgtggccaagtcagcagtgcactggggcgggcagggctggctggccttgggtgagaggggacacctggatggcaaactgatggaggctggccttgcagcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 16 - DNA, 3289 bp, Homo sapien
catccaatgagacaccagctcaggttactgcaggggacacactataaagccctgagctcagggaggagctccctccaggctctatatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcaggaacaggaacaggctgggaagtgtgtcctgagagccagcagcgtggttgagcagagggtgggccggcaggggacttactctgaccccgccccccggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtg

SEQ ID NO: 17 - DNA, 1390 bp, Homo sapien
aattcaagaatgtcactgccagttaaacctgaattgttaggggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 18 - DNA, 1363 bp, Homo sapien
accagacctaggaattcctagaaaaatagtcaggaagcatttagacacatcaaatgttaaacgagtcctgattatgatgataatgatgatgattttggtggttgcaatagcaaagccttaagtatgaaggagacgtgccagctggaaatacaggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 19 - DNA, 2382 bp, Homo sapien
gcctcccctgctgactgctgtagctagccttgccccatcccaccccttccctctccatcctcgctcttttctctcctggtttatggtttgtctcttcctcaaatgcaatttgcaaaactctcctgaacgaaacaacagcttctgggaggtggtggcagctgcaggcacagtggcgccgtgggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaatgagttctggagcgccttgctggaaaaagcctacgccaagctaaatgggagctatgaagctctgaagggaggcagcgccatcgaggccatggaagacttcaccgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagt

SEQ ID NO: 20 - DNA, 377 bp, Homo sapien
gcccttagcgtggtcgcggccgaggtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 21 - DNA, 1056 bp, Homo sapien
ggtaatagagcttcgacttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacggggtagcggccgccgcggccgtatttttcacatccatcataaggttggcattcaataaggaaaaagttctaactccagtattaaattgtacataaatcccaaatgttcttaaagaacactcagggacatgtttgttgcctggcattggtaatgaaaggttggtttttgaaacttgaaatttcaccattggtttttttcctatcatttctgcatatccagcaaaaggaatctcatgttgactcctggcagagttcagtggcttcagtctgtctatctgcgg

SEQ ID NO: 22 - DNA, 772 bp, Homo sapien
acaaagttaaatttcaacacattctctatgctagtgtgacaaaagcagccccataatttggtttttattgttgacctttacaggatgaaggagacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtacctgcccgggcggccagcgtggtcgcggccgaggtacagcgacagcgtcggcagggtcagcttccccagcctggtctgcttcctgatgcggcttgaagccatggcaaagaccttccgcaactctctaaggatggaaaaggactctacctgacagaaatggagtggatgagcctggtcatgtctggttgccaggaggagcaagcaaagtcagcaggacatgaagttgtattaaatggacttcgtgattttgttttgcactaaagtttctgtgatttaacaattaaattctgttagcac

SEQ ID NO: 23 - DNA, 1594 bp, Homo sapien
gggctttttcgagcccataggtcgggacagcccaggactgggcatgggaggcttggagtggctctgggtaggggcccagccagtgccctaggggacttcatataccctctcttcctttgcaggaaaccccctcggcttcaggacttccgctgcttagctgtgctgggccggggacactttgggaaggtagtgggctgaagagggtggtatgggacaggattgggggcctcatcacatgagccgggaggacctgatctgtgggggcggtaaaggctccctggtctggcccacctggagcacaacctctctctggccccaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaag

SEQ ID NO: 24 - DNA, 2365 bp, Homo sapien
accgcacctggcctagtatacattcttgtagtgactaatatctagtctgggccaaccactccgaggagagagacaattttggattagcccacattacaccaacaacgtgcgagacaaagagagacttgaggggcttggtcgaggaggcccagcgcgttagaggcgggagccaggttgtagaggggctcaaagttagaggaggcggccagctccaccggctgcacccggctgggcgacccggcaaccttcagggggcgctgtttccccatccctgtcccctaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaag

SEQ ID NO: 25 - DNA, 988 bp, Homo sapien
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccaggtgggagctcctcaagggccctccccaggaagtgttcctctggatgacctacctggggcagaggagccagaatatggaggagatggctgtggtggggagagacttagtcctgtgtcttccccacccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 26 - DNA, 1591 bp, Homo sapien
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcaggatatcctgcccctgcttctggggtgggtggtctgtgcctctggaagctttggactcacccaaacccgaatgggaaccctgatgtgtgatcttgaacacgtgacctctaggactccactttttctgtaaaatggtgctgatgaccacctgttctgtgtgagaggcttagagggacctgcagcttccccaggttgcccacatcggtggagtgtgagctgggtctggaaggggtgggggcctgcgggtgggaaaccagaaatcaccagtttcccttgactgcccacgctcacacactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtcccggcaggcggcttcactcagggtcagcgggcaccaggttgctctggaagagcttgaggatgtggttctcgatcacctgttgcactgagatggggcagggaaaagcgtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaa

SEQ ID NO: 27 - DNA, 1193 bp, Homo sapien
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtcccggcaggcggcttcactcagggtcagcgggcaccaggttgctctggaagagcttgaggatgtggttctcgatcacctgttgcactgagatggggcagggaaaagcgtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaagcaaaa

SEQ ID NO: 28 - DNA, 598 bp, Homo sapien
acaggtgcccatgcctctggctgcattggtgaggatccccagggcataccctgccccttgatgaggcccaccccacgggtggttgtaccaacccttacggcaagtccaagttcttcatcgaggaaatgatccgggacctgtgccaggcagacaaggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 29 - DNA, 1696 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 30 - DNA, 1939 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccaccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 31 - DNA, 2082 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccaccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 32 - DNA, 1081 bp, Homo sapien
ctattggtcaggacgtttcctatgctaataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagcagcacaatcagcagctggggcgccgcagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 33 - DNA, 1075 bp, Homo sapien
ctattggtcaggacgtttcctatgctaataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgaggtcactacattaaaccataagcttcaggacgcttaagacctggttttctcttctcagtcgctccacctctgcagacgcgtctgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 34 - DNA, 672 bp, Homo sapien
ctccgaagtctagagagagaggctgcaggggaagggactgggcgcagaggtgaggggccttggggaaggagggagaatccagtgagaaggatgccctggatcgggggcgggctgatagctgtatggggcggggctatcaatgggggcgggtctatcgatggaggggaggggcttatggatgggtggggcgggtctagcgatgggggcggggcttggggccgggcttggagcggggccagtgcctgctgcctccagtctgccctgagtccctcttctggtcctttaggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 35 - DNA, 2184 bp, Homo sapien
aggcagacgggaacctgagactttgtccaaacctcggctggaaggctggtcttggcactcggcgtcttagctagtggatttatcgcattaagactgtacttgggcctttttcatgatgacttgggtctcaatccttggagcagctgaaagaacagctcgggccacctgtggatgcacccacaatgaaatcagaggccacgtgaggtttgcaaggcagagtggcctgcagttttaactcgggcactatggcaatgcagacccaaaccaattgtgccagttctttgctgggtggcaaagtgttttcaggcttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgaccgggagcggggcgaggaggagggtgggtatgaggcggtagcggaccgcggagtcgagacctacccgaacgacgcgggcgagcggggctttggacgccggtggagacgcaggcgagggctgctgtaaaatattacaggcatactttggagatgttatgggtttggttccacatcactgcaataaaactccagcgggaggaagaagaggcctttgccagcagtcagagcagccaaggggcccaatccctcatattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 36 - DNA, 2515 bp, Homo sapien
ctggcgaggtggcccgggctcggccctccgagggtgtggagcgcccgggaaacgggaccccaagaatccaactgctcccaccctgcgcggccaggagcggggctggcgatactggggacactgtccaatccgggcagggggcgaggccgggggaccgggcgggcctggggagcaggcacgtgtggagggcggacccgccgggggtcgaggcctgcctctccgagagctcctggcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcgcacaaacaacgaggaaacagaagattcaccaaacatttatgaacagccagctgttataaagacaagggaccaatctgaaaaatcagaataaagtctccttgttaaagctgctgcaagaaacaggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaa

SEQ ID NO: 37 - DNA, 1948 bp, Homo sapien
aagattcaaggtcttgctatgtttcccaggccagctcttcacaggtgccatcttagctcactgccttgaactcctggcctcaagacatcctcccacctcagcctcgagtagctggaactacatgcacatcccgacccccttttggcagaggttgatcaatgtagatttgccagttaggaaggcatgagtcagctgggaagacacaggagagtggggtggtgggggaggccaggagatagtggagggagctgtccttgggaagcttctcctgctattggcagaggcactcatgcaacgttaggggccacactgaggctcagccctctaggcacacatcagagccattgtaataatgcgagcgcatttagaggacgtctgtcctccctccctgggtctgaagctccaattcttgtggtattttgtctcattactctagacctgctatcttaatggtgtccccagatcttcatgtatactctcgaattattttttatttgtttttctcatcctcagggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaa

SEQ ID NO: 38 - DNA, 3633 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagaggtgacaagtcttccttcaataaccaagaagagttccagcttaatgtctgctgaatctagaatcttctgacttgtattttggcccagcccacaatcttggatgcagggtgcagcagtgtttacaaacctcacaccccatttccagaatagcaggtagaggcactggagctttgattactccagagcccccaacaagcaagatggggcctggcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 39 - DNA, 2589 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 40 - DNA, 2695 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagrcctgtggctgcctgggggtccggctgtctggtactagctttttcataccggcgcctcgcgggggcccttttacgcg

SEQ ID NO: 41 - DNA, 2267 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacgatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 42 - DNA, 415 bp, Homo sapien
ctcgatgtaacaccccgacgtcttcacaaattaaatttcaacacattctctatgctagtgtgacaaagcagccccataatttggtttttattgttgacctttacaggatgaaggaggagaatcccctgtggcatrccaatgaatctttctggtggggacagctgacgaggccacgcgggcagagatccagatccgaatcgaggccaacgaggccctggtgaaggccctggagtaggcggacatgtgttatctacytcaaggtaacaagagtatgtggcaaacatataccacccatagtgcttcacaaatgcacttctatttagccagcgtttattgtagtaaactattcttaatagaagtgcattttgtgaagcacacctcggccgcgaccacatccatcacactgcgccgctcg

SEQ ID NO: 43 - DNA, 1805 bp, Homo sapien
acgtgcatgttgaatcaatgcaagagcgaaatggttgctgtgaaatccctttaagaaactacattattcaagtaatgaaaatcactcagttctacttccagagaagaactgatgagaaaggtctttaacagtaattgaatggaacaagaagatagtatttttctgggactgtgtgtctcctttggtcttctcccctccttcctgtcactgttgcatacggtggtttctgcaatggctgatccagtttgccacattccactccggctgctgtttctctgagattttcttgagtttttatcaaaccaatccccagataaatcacaattgctctagaacaccagccctcagggtaacatgttagaaattagcttgaaaccctcaattttgagggtttcccatgactttttaaacgttgtccttcagtgtagccccttgctcctaaggaaagatttattttcaaaatagttttcaaatggatgctcttctgtgatggagctaaaaaggaattatttccatattaattaatgatgaattgaggatgcctaagtatgaaatggaagacggttgtatatttctctcaaatgtctctgaaaatgaagtgatgattatcattaacaacaatgtgataagaaattaatataatttaaagcagcaagaacaaaatccttctttccgatagctggggatttggaaacttggtcctgctcaatgctgctgctacttcttgtgtcactatgaacccatcttttggcctctctgagtctcaggtacacccccacgattagactacaaggccttataccgctctgacattaccagtcaataactgtacaacagagtctaagggaatccttttatctctttgcagaaaacatgataatattattttaattatttgtaaatgcaggcttattatgcatgtgtttaaacaaagaaaatgtagcgtttctattaaatctttggattaaatatggttgtgtaatgaagtaaatgtcatgtgtatacacttaacattctaaaaatttgtttcttttactttagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgcta

SEQ ID NO: 44 - DNA, 806 bp, Homo sapien
  misc_feature (760)..(760): n=a, c, g or t
  misc_feature (772)..(772): n=a, c, g or t
  misc_feature (803)..(803): n=a, c, g or t
cgggcgggatcagcgagcgtcgcgatgtgatgacgtcaggccccggacaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagaaattgggcccccccccaattttttttnccctttttcccnaaaattttttttttaaaaaaaaatttttttnaaa

SEQ ID NO: 45 - DNA, 6351 bp, Homo sapien
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttaggtgagtggcttgtctgctatggcagagattagaggtgctgacagactgccataagtattaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcgtttcaaattccattgtagagagtctctgataatctcacttataccatgagccattcctcagtatctgtcctcttcctgttagtgttctacaattcctttctccttaatttttctccgctttacaaaatgtcacacagacaagtgcatgatacttaaacaagcttttaaaaataatgctcataaatagctttggttctgtcataatattcgtatttataaacattttaagtcaattctcttcttttattttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgacgatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttctttggtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcaggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 46 - DNA, 5654 bp, Homo sapien
cgcaatcagtattttcatacatatttaaaattttccatccatacaaaggttgctaacatatttatttaaaattttaaaaataattttatatgcctcttgtaaccagtaataggatgcaaagtttttttttaaggtaacattgctcctcttcccccattgtctctgtcatctatagtactccctgaggtagttcatgttattgcaagggtgtgtatcatcacaaacatattgcttccacatacatatatcagcatacatatatatatatgagcacatattaatatatgcccatgcacatacaagcatgtttttgttaatttttactgaaatggaatcatactacatacttatgaacaaattgcttctttcaccttatatcacttataattgttattctacaaatcagtacatataaaaaatacatatttacatatgtaatactctatctttctgttataattttctgcatgcacatgtatgcatatacatatattcataaacataaaacttaatctaaacgggatttttttttgggggggtgatatggtttggctgtgtccccacccaaatctcatcttgaattcccatgtgttgtggggggacccggtgggaggtaattgaattatgggggcaggtctttcctgtgctgttcttgggatagtgaaaaagtctcacaagatctgatggttttaaaaaggtgagtttccctgcataatctctcttctcctgtctggttccatgtgagatgtgccttttgccttccgccatgattgtgaggcctccccagccatgcggacccgcccataggtggaagggacttgccttgtctcggatgagactttggactttggactgtggacttttgagttaacactgaaatgaattaatgctgaaatgaattaagactttgggagacggttgagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttaggtgagtggcttgtctgctatggcagagattagaggtgctgacagactgccataagtattaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcgtttcaaattccattgtagagagtctctgataatctcacttataccatgagccattcctcagtatctgtcctcttcctgttagtgttctacaattcctttctccttaatttttctccgctttacaaaatgtcacacagacaagtgcatgatacttaaacaagcttttaaaaataatgctcataaatagctttggttctgtcataatattcgtatttataaacattttaagtcaattctcttcttttattttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgacgatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttctttggtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 47 - DNA, 1678 bp, Homo sapien
agcggctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccgctgtgggaatgtggcagccatcttggagctggacgagcatctccagaaagatttcatcatctttgaggctgctccccaagagacacggggcaaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggc

SEQ ID NO: 48 - DNA, 1437 bp, Homo sapien
catcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggc

SEQ ID NO: 49 - DNA, 2785 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacacaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 50 - DNA, 2871 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtatcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcaaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 51 - DNA, 1214 bp, Homo sapien
aagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 52 - DNA, 4667 bp, Homo sapien
tggggggagggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtaaaaatagtgataattctgattacaataaatgagtaacacttcaatacggttcatggtaactggaatagttaagtaaacttattctttaatagcttttattcaactcttaggttgacttttttgtttgtttttgagacggagtctcgctgtgtcacccaagctggagtccagtggtacgatctcagctcactgcaacctccgccttccaggttcaaagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattacattcttaaaatagtagatagtagcagtcttttggagtatgtgtttaactgccaactatgaatgggttagcacaaagtggagatgaacaaagatttcatgtcattactgaagagcagacatagccttttgaagcagctgaaccattatgggataaactg

SEQ ID NO: 53 - DNA, 1829 bp, Homo sapien
gcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcaacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 54 - DNA, 2679 bp, Homo sapien
cagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccagtgagtgggccagtgagagggtgggcatgtatgggggaaggcttagccagtggcctccactctgtccccaggcctttgggagtcacccctccatcctcagagcgcctggagtaggagtgggagaggatgccagtgtgaggtctggggcactggggagcagctgagtctctgagccctcagtactgactggtctttcccctcatcattctgcagagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 55 - DNA, 3125 bp, Homo sapien
cagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccagtgagtgggccagtgagagggtgggcatgtatgggggaaggcttagccagtggcctccactctgtccccaggcctttgggagtcacccctccatcctcagagcgcctggagtaggagtgggagaggatgccagtgtgaggtctggggcactggggagcagctgagtctctgagccctcagtactgactggtctttcccctcatcattctgcaggtaagccctgatctgtcctgtaactgaggttagcatgtaggtatcaactcacggatcaactccacctgttgtgacagcctaacctgtgttgagaaggatgccaaggtggcctatagagacagagtaccgtaatcaaatggggatgcctgccacacacgagggagggagtacagtaaagtgcgtgccgatgtctgtcagcagcgtcccaggcttcccccaagttaactgcaaggagagcgacttgagctgagacctgaggcccaccagagttcctctgagctcctggacagagctgttcagctgttcatatgtgggaggtctgagtcgggtgcccatgtccttccatacctggcatccatttgacttggtctcttccatagattgggggtgggtgtcagaaccaggcaggccctgggagccccttattctaccccttcttcccccagagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 56 - DNA, 2774 bp, Homo sapien
cagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccaggtgggctttactcccctccccatcccccatccccaccacatctctagcccatatcatccctatgcccctaagcagcctgcctttgaccaagccattcctcccctcagagtttgtggaaggaccacaaacatcccaccccttccagcccagcatcgtcctatgaggatctgcccagtttgcgtggggcaggagtggggttggtggaaagggaatgggggatgtgctgtgtctgggcagagagggccaagtagaaggtgggccctgggcacttgttctttgcttgagcctgacctcccctccacccgtcctgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 57 - DNA, 1779 bp, Homo sapien
cagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaaggtgagatcctccccaggtgccctggatcagggcagacgctgacactgccatcctcactatttccatccagcagtgcctgaggggcctgctgggtgtacgggcctgtgggcacaaagagccagggtgggctccccgttctccagatggctcagcttcttccctggctggctcttgggctttcttctgtggctctgtgttttccaggcatcactcattctccgaacaccttcataacttcagccatgtccaccacatattgctcagatcttatttacttaatcagttactttttaaatgtaatatattaaaaaggaactttcacatcactaccataaatgggaagccactattacttgccaaacattgaaaaacaacacaaataaatataataaaacagtaagttttagcttgccaggcg

SEQ ID NO: 58 - DNA, 1004 bp, Homo sapien
ggtgggaggaaaccgcctggagccgccgggagtggacgccgccgaggcccggagtcgcgcctgcaggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaa

SEQ ID NO: 59 - DNA, 1233 bp, Homo sapien
ggtgggaggaaaccgcctggagccgccgggagtggacgccgccgaggcccggagtcgcgcctgcagacacagcatctactcagcgtgggtcacctctgtgaacatcactgactgcaagcctccctcaatttctggtaaattttttccttcaagctttttgaggtcagggggaaaatcctccacagatcttcacgagtctggtcccagatcactaacagctaaaggttttgtggtggggagaacttctgtgccacttggcttccattagcctgcccaccctgaccacacaatgcaggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaa

SEQ ID NO: 60 - DNA, 1112 bp, Homo sapien
ggagtgatgatgagtattaaaaatgctggccctagagccatgccctgtagtccaacctgcctcaaccacttcctctctcctctgtcctgggcctgatgtgaggaatatagactggcatgttctgtgctctgagagcttgtgacttggttgttgggattcttatgggtggcatgggggattgctgagaaaggagggtgtgaccctgggtggctgtaggaagggcaggatgcagcctagagaggttgattcctggcaggtgcctcaacccaatgattcattcatctctctctgtcttcacattccagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaa

SEQ ID NO: 61 - DNA, 478 bp, Homo sapien
gaaaaaagaggaaagaaagaaaaagggagaatgwtratactataggcactggttctctaatgcatgctcgagcggcgcagtgtgatggatcgcccgggcaggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggtaaaaaaactctgagcct

SEQ ID NO: 62 - DNA, 5650 bp, Homo sapien
cgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcaggctgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccgccgggcaggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggtaaaaaaactctgagcct

SEQ ID NO: 63 - DNA, 443 bp, Homo sapien
gaaaaaagaggaaagaaagaaaaagggagaatgwtratactataggcactggttctctaatgcatgctcgagcggcgcagtgtgatggatcgccgggcaggtgtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggtaaaaaaactctgagcct

SEQ ID NO: 64 - DNA, 359 bp, Homo sapien
catgcaccctccaggtatttctttcatttctagggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggtaaaaaaactctgagcct

SEQ ID NO: 65 - DNA, 954 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 66 - DNA, 1519 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgaggttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 67 - DNA, 2459 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagtttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 68 - DNA, 575 bp, Homo sapien
caatggcagccggcccaatggcagccgtagccgtgcgggccgcacgcgttagtcgccctggccggcctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttccgcattgggccggctgccattgggcaatggcagccgcccaatggcagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 69 - DNA, 638 bp, Homo sapien
ccgccctgctcgaggcctgggccagggacagaggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 70 - DNA, 951 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 71 - DNA, 2458 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 72 - DNA, 5495 bp, Homo sapien
cgggtggggaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaaggtatatgcagccctgcctgcctcccggcgccgtggagcacatgaagcccaggggagagttgacaggattgtctctgtcacctgtgagactcgtgtgtctcggtggggcttttccacgacaccctatgaagcacagttgcgggatgacagctcagtccgtcctccaggaggcccccgcctaggaagacactgccagatggcgccagggtgaccgtcccagctgggcggagtgggcacccccggggcttcctaagttgggtcagtcccgctcgggtcctagcatggcctcggaaggagacacccccaggtgctcgtgtctgacggagccttccccttgctttgtagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccgtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 73 - DNA, 4927 bp, Homo sapien
cgggtggggaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaaggtatatgcagccctgcctgcctcccggcgccgtggagcacatgaagcccaggggagagttgacaggattgtctctgtcacctgtgagactcgtgtgtctcggtggggcttttccacgacaccctatgaagcacagttgcgggatgacagctcagtccgtcctccaggaggcccccgcctaggaagacactgccagatggcgccagggtgaccgtcccagctgggcggagtgggcacccccggggcttcctaagttgggtcagtcccgctcgggtcctagcatggcctcggaaggagacacccccaggtgctcgtgtctgacggagccttccccttgctttgtagtcccgggtcacagtgaagcatctcgaagagattgtagagaagctaaaaggagaacttgaaagttcggaccaggtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 74 - DNA, 3012 bp, Homo sapien
cgggtggggaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggctgagggggcccagaaccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaacgtggccaaagtggaaccagctgtcagctctgtagtgaattccatccaggttctcacttcgaaggctgccaggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 75 - DNA, 541 bp, Homo sapien
gggcaggtctcagcgctcctccccctgctccgctcctctgcagggcccaggcgcccttggccttaggacccaacttctcttaccgccatggagttcgacctgggagcaggtgagctcctggggagtgtggactggaggtgcagggggccggactcaagcccagaagctgcctgcaccaaccacccaacttctctccacagccctggagcccacctcccagaagcccggtgtgggggcgggccacgggggagatcccaagctcagtccccacaaagttcagggccggtcggaggcaggggcaggtccgggtccaaagcaaggacaccacagctcttccgactccagcagcagctccagcgattcggacacggatgtgaagtcccacgctgctggctccaagcagcacgagagcatcccgggcaaggccaagaagcccaaagtgaagaagaaggagaagggcaagaaggagaagggcaagaagaaggaggctccccactgaagggccctggacagggctcattaaaccttcctctctgccttc

SEQ ID NO: 76 - DNA, 832 bp, Homo sapien
gggcaggtctcagcgctcctccccctgctccgctcctctgcagggcccaggcgcccttggccttaggacccaacttctcttaccgccatggagttcgacctgggagcaggtgagctcctggggagtgtggactggaggtgcagggggccggactcaagcccagaagctgcctgcaccaaccacccaacttctctccacagccctggagcccacctcccagaagcccggtgtgggggcgggccacgggggagatcccaagctcagtccccacaaagttcagggccggtcggaggcaggggcaggtccgggtccaaaggtaagtcgcctcatcaccggctgcggaggggcgggaaggctggggttgcccctgaccccagggtcctgccttaggcctccaacttcagggggctgggtaaggggcgccgcctcactgccgcacctccatccagcaaggacaccacagctcttccgactccagcagcagctccagcgattcggacacggatgtgaaggtaaggggctctcgccagcgtccccaagcacgtgccctgcaccccagagaggcgtccccgcactggggctggcggggagggtgcggggagtggtccccctgtctcgcttccagcccagaaccatctcttctctcccatccctgccctcggccccacagtcccacgctgctggctccaagcagcacgagagcatcccgggcaaggccaagaagcccaaagtgaagaagaaggagaagggcaagaaggagaagggcaagaagaaggaggctccccactgaagggccctggacagggctcattaaaccttcctctctgccttc

SEQ ID NO: 77 - DNA, 991 bp, Homo sapien
aaaattaggctaggtacgaggcytgggtgtaatcggccgaggcgagcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccaggggaayytcccggcsctkgkccarggggggccggggggcggcccgcggggggacccctcggggcgcccaggggacagaaccggg

SEQ ID NO: 78 - DNA, 1675 bp, Homo sapien
ccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggagggagc

SEQ ID NO: 79 - DNA, 432 bp, Homo sapien
agtgtgatggatcggccgcccgggcaggtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaacaaaaaa

SEQ ID NO: 80 - DNA, 428 bp, Homo sapien
tgatggataggtcgcggccgaggtacctggccatcttgggcagtgtgacgtttctggctggcaatcggatgctggcccagcaggcagtcaagagaacagcacattagttccagaagaaagatgggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaacaaaaaa

SEQ ID NO: 81 - DNA, 846 bp, Homo sapien
  misc_feature (66)..(66): n=a, c, g or t
  misc_feature (96)..(96): n=a, c, g or t
  misc_feature (6)..(6): n=a, c, g or t
  misc_feature (100)..(100): n=a, c, g or t
  misc_feature (118)..(118): n=a, c, g or t
  misc_feature (120)..(120): n=a, c, g or t
  misc_feature (180)..(180): n=a, c, g or t
  misc_feature (191)..(191): n=a, c, g or t
  misc_feature (205)..(206): n=a, c, g or t
  misc_feature (211)..(212): n=a, c, g or t
  misc_feature (330)..(330): n=a, c, g or t
  misc_feature (844)..(844): n=a, c, g or t
aaaatntaagaaggttcgcagacctgacatccagtaccctgatgcaacagacgaggacatcacctnacacatggaaagcgaggagttgaatggtgnatanaaggccatccccgttgcncnaggacctgaacgcgccttctgattgggacagccgtgggaaggacagttatgaaacgaganagctggatganaagagtgctgaaannaaaannaaaaagmagtccagattatataagcggaaagctaatgatgagagcaawgagcakrccgatgtgattgatagwmaggaactkkcmaaagrmagccgtgaakycmacagccatgaatkknacagcmakgaagatatgctggtkgtagacgccaaaagtaaggaagaagawaaacacctgaaatttcgtatatctcatgaattagatagtgcatcttctgagktcaattaaaaggagtaataaaatacaatttctcactttgcatttagtcaaaagaaaaaatgctttatagcaaaatgaaagagaacatgaaatgcttctttctcagtttattggttgaatgtgtatctatttgagtctggaaataactgatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagacgcaaacaaaatacttttacccacttmaaaagagratataacattttatgwcactataatcttttkttttttaakttagtgtatattttattgtgattatctttttgtntg

SEQ ID NO: 82 - DNA, 806 bp, Homo sapien
aagagtggtatcaacgcagagkgcccattacggccgggggccgccatcttggggctgctgggactcgcgtcggttggcgactcccggacgtaggtagtttgttgggccgggttctgaggccttgyttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgtgttaaagtaacagatgatttagttgtgttggtgtataaaacagaccaagctcaagatgtaaagaagattgagaaattccacagtcaactaatgcgacttatggtagccaaaggaagcccgcaatgttaccatggaaaactgagtgaatggtttgaaatgaagactttgtcgtgtacttagggaagtaaatatcttttgaattagagaaagtgttgggacagaaagtactttatgtaactaagtgggctgttcagaagcttagaggtcatttttgtaattttctttttaaattactttagagagctagggatgcaaatgttttcagttagaaagcctttatttactttgtggaaattgaacaagaaatgcatctgtcttagaaactggagattattgatgttaggtaacacatgtaatggttctcgtggcaattgtgtctcagtatttggaaatgagatttacggaaaaccattttttaaattagtcatgcttctttaatgaccctagtgtacacttggtgatcaggtttggga

SEQ ID NO: 83 - DNA, 2606 bp, Homo sapien
aagagtggtatcaacgcagagkgcccattacggccgggggccgccatcttggggctgctgggactcgcgtcggttggcgactcccggacgtaggtagtttgttgggccgggttctgaggccttgyttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgtgttaaagtaacagatgatttagttagacagtgtcttgctctatgtgctccaggctgcagtgcagtggcttgatcatggctcactgcaatcctcgacctcctgggctcaagcggtcctcttgcttcagcctcctgaatagcagagactrcagcgggtagctgggattacaggcacctgccaccacacccagctaatttttatattcctagtagagacagggtttcaccatgttggccaggctggtttcgaactgctgatctggtggtccgcctgcctcggcctcccagagtgctgggattacaggcgtaagccaccacgcctggccaagaaaatcaagatttacctggwttatgtgttgaccagctatacacagagaattctagattttkttctaaaaattattatcaaacccssaatttcaccagtagaaaaagagatcttaagatttctgtgtttttttttccagcataactcagttacttatggctgggagaaaatatgtagggagataatctaatacctaattcgaaggragaaaatatctaattctaagtcttgagttcttctyatymgaccatagcaggstttaacatttwacatttttcaraagcttctaawagacytcattcarttttttgccmcagcagkggcatttaaatmactgrctttamarccatgaatygctggaggsttggaaacttgagtcaatttccctagtacsacctccaaggcagaactagcagcaaaacagtggtaggaaaaactctcaaaattttacccaatctgtatgtttctctacattgtcagtatctagttcttatatagtctcacatcatgtcacttctaacaatttcctgacagtgttggtgtataaaacagaccaagctcaagatgtaaagaagattgagaaattccacagtcaactaatgcgacttatggtagccaaaggaagcccgcaatgttaccatggaaaactgagtgaatggtttgaaatgaagactttgtcgtgtacttagggaagtaaatatcttttgaattagagaaagtgttgggacagaaagtactttatgtaactaatcttctgatcatcccacttagttacataaagtactttctgtaactaagtgggctgttcagaagcttagaggtcatttttgtaattttctttttaaattactttagagagctagggatgcaaatgttttcagttagaaagcctttatttactttgtggaaattgaacaagaaatgcatctgtcttagaaactggagattattgatgttaggtaacacatgtaattgtttctctggcaaattwgtatcagtaatttgaaaatgagatattaggaaaaacaattcttcttaaatttagttcatctttctttcaacacagcaacatatcaaatgtaacccatattagtccagatccatgtattatggagcatacaaatgtatgctgtagtgaccaataaatcataacatatggtaattggcacttaactccacaccactagtatgcacttgttcatacactactgtgtacctaattatagtatacgcagtgtagtctcaattaataatctgaaacgtaacttagtggcctaaacaagtatgcaatagaacttattctaccacatatcaaacactacccatgcaaaactactacacgggggatacacgcaacacaactacaagacaatagaccagaacgcaacgaggcactataggacaaaacataagtcacacacaccaacgacacacgaaaccccccacacacgcaataactagaccactgatacggacactggcggaacctgactggaaatccacaagatcgaccaaatacatcgggaacccgccacaccgaaacccaaaattagacaaggcaaaaatcacagcaacgacaccaataaataagaagcccaacactagacacacaagaaaccccccaccaaaccggcgaccaatgccaatacaccagcaaacgcacaccaaggacaaaaaaagacacgaatgacacaaaaccgtcccgagggaaaaaaacacaaacagaacacaaaaaaaacacaagaaacacacaacactaaaagcccacaaaaacgcaacaaaacaaagaaaacaaagcaaaaacaaaaacggcaaccccactggcaacacaaacagaacaaaaatgagacaaagttcacgaagagctaagagagagaaaagcaaagcacagggaaccatggaacagacccacatacagtgcaaacagggacggcaacaaacacaaaaagaacaagaacgagcaccgagaagcacaccctaaagaaaagcaaaaagaaaacagaaca

SEQ ID NO: 84 - DNA, 1850 bp, Homo sapien
aagagtggtatcaacgcagagkgcccattacggccgggggccgccatcttggggctgctgggactcgcgtcggttggcgactcccggacgtaggtagtttgttgggccgggttctgaggccttgyttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgtgttaaagtaacagatgatttagttagacagtgtcttgctctatgtgctccaggctgcagtgcagtggcttgatcatggctcactgcaatcctcgacctcctgggctcaagcggtcctcttgcttcagcctcctgaatagcagagactrcaggtgttggtgtataaaacagaccaagctcaagatgtaaagaagattgagaaattccacagtcaactaatgcgacttatggtagccaaaggaagcccgcaatgttaccatggaaaactgagtgaatggtttgaaatgaagactttgtcgtgtacttagggaagtaaatatcttttgaattagagaaagtgttgggacagaaagtactttatgtaactaagtgggctgttcagaagcttagaggtcatttttgtaattttctttttaaattactttagagagctagggatgcaaatgttttcagttagaaagcctttatttactttgtggaaattgaacaagaaatgcatctgtcttagaaactggagattattgatgttaggtaacacatgtaattgtttctctggcaaattwgtatcagtaatttgaaaatgagatattaggaaaaacaattcttcttaaatttagttcatctttctttcaacacagcaacatatcaaatgtaacccatattagtccagatccatgtattatggagcatacaaatgtatgctgtagtgaccaataaatcataacatatggtaattggcacttaactccacaccactagtatgcacttgttcatacactactgtgtacctaattatagtatacgcagtgtagtctcaattaataatctgaaacgtaacttagtggcctaaacaagtatgcaatagaacttattctaccacatatcaaacactacccatgcaaaactactacacgggggatacacgcaacacaactacaagacaatagaccagaacgcaacgaggcactataggacaaaacataagtcacacacaccaacgacacacgaaaccccccacacacgcaataactagaccactgatacggacactggcggaacctgactggaaatccacaagatcgaccaaatacatcgggaacccgccacaccgaaacccaaaattagacaaggcaaaaatcacagcaacgacaccaataaataagaagcccaacactagacacacaagaaaccccccaccaaaccggcgaccaatgccaatacaccagcaaacgcacaccaaggacaaaaaaagacacgaatgacacaaaaccgtcccgagggaaaaaaacacaaacagaacacaaaaaaaacacaagaaacacacaacactaaaagcccacaaaaacgcaacaaaacaaagaaaacaaagcaaaaacaaaaacggcaaccccactggcaacacaaacagaacaaaaatgagacaaagttcacgaagagctaagagagagaaaagcaaagcacagggaaccatggaacagacccacatacagtgcaaacagggacggcaacaaacacaaaaagaacaagaacgagcaccgagaagcacaccctaaagaaaagcaaaaagaaaacagaaca

SEQ ID NO: 85 - DNA, 924 bp, Homo sapien
gcagggcttccactacacccccacgtggcgagcgccatccaagaccttgtgttcaggcagaggctgggtcgggcccccacctgcctgggcctggccctctaagcccccttgggctcccctgctgctctctgtggtgaagcctgtgttgctggtggagctttagccaggtgagtgcagccaggttaagtttctccaggtgtccaaggggacagctgcacggagtaaaaaggcaagtggaaggatgtgggccagaagggcaagcacaataaagctgaaattcaccactagcaaaacatcctcagagtcacaagagccaagcctgaatcagcgttgctctttcacagcccaagggtgacccgaaaacgcccatcctgggcagccttcctcgactggcagggactcaagggccggaagtgcgaggtggccgtgccaggctgtgccagcatgcaccagggcagggagcattctgcccaaactattgactcggactacctgctcacagtctgcagaaggcacgctggcggcctcaagcggggctgcatcctgcttccttctcttgctgggtatggcattagcagcttcccattcatcggatatgaggtctacagcagcatctaccaaaacctctgatgtagctccctgttgaaacacgacccccttcagacagggcagggctgtgcaccccacwgcacagctccagtagactcgcaaagaccccacctcaggggccacctcctcttgggaaggcccaggcagggacacccacatgtgggcactgaccagcttcccagcaccgtctgcctccagggcccatgggcaggagggtgtgggaagacgaagaagcagctcctgcagmcgtgcaggacaagtccacgtaagaggagaactgcccacaccagaggcggcagcactgccaggctcacg

SEQ ID NO: 86 - DNA, 847 bp, Homo sapien
agcggagggttcaccctccgctccacagggtcggcagcagggcggggcctccggaagctccgccccacgctttcccggggcgcatgcgacgtgggccggagcgtctggaagctccgcccgtcgcactgtagagtcggccgaggcgcacgaggtatttttcacgctccgcccctctgcaggctaaagtgcgtgggcgggaagcggtgggcagggtgccatctggctccgcccttctcctgtggtgtgggccaggcggcggcttcctcctcctgcagcagccacaggctccactctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagagggagagaggggggaagacgagagaacaggcaatgggaggtgatggtgagagcttattggaacagacaagagggaggaaacccacattccttcattccccatccattcatttatggccttatgtattccattgaatcttcacagctctagaaaaaagtgtgctacaattattccctttattacatgaggtcactgaggcacagtttaagaaaatttgccagcaggcacagtgggtcactccggtaattcgcagaactttgagaagggggaggaaggtggatccattgaagcccaggaagttggagaccaggtctgggcaacaatgggggagaccccgtttctacaaaaacttaggcaaaattagcaaactggttcacacttgtagtcccagggtattca

SEQ ID NO: 87 - DNA, 1389 bp, Homo sapien
cttcgggcctaaccacaagaggcatgtctggttccgcgagagcatgaccgattggattccagttcgagtatgccgcctagggctccgatcctgccgatgtggcctatccagctgacctttctgcgcctgatgtccactggaggcctcccaggacatcacctaccactgcaagaacagcgtggcctacatggaccagcagactggcaacctcaagaaggcctgctcctccagggctcaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaawwwwamamaargattawttaattttttttsmamaaggaagctgggccccctggcttgaaaacccatgcgggggtaggtcccttttggcccgtggggtttttgaaaccccaatggcgtgccctttcgagctccttttctcaaaacccccctgggggccttcccctccactccttcccaaattctggtctccccagaagacacagggaaacattgtttggtctgcccagcaaatcaagggcaatgctcaaacacccatgggggccccaacccttcagcccgtccgtgcccgccaaagaaccccaaggccctgggggacatggggctcgcttcagagttgccaaaaaaagccttgtgccaaatcagggggcctcccaaggggctctgttgaaaacattgtcccctacggtgatatggaggggggtcaatgccggggggaagccaccaaggccccatcaacggggattccagaaggagcagccagcaaggggcccacggctacgaaataaccgccgagaaaccaccggttgggcggaaccgcgtgtcaaatacccttggttgcccgcaagggacggggaccggcgcagagcatggtgctgtacttggtgttactggtgtgcgcggaaaaaataccccggcctggtcctggaggtgccccgcgacaaattgactgcggcgggaatgaagacagatgaaggaccccat

SEQ ID NO: 88 - DNA, 3429 bp, Homo sapien
ctgtagtgatctgaggatcccttcgattggtgtgggaacttattggtgctctgagtagagggcctgatgaggttgacagtaatgattgaaagaggcatttgagtgattcacagtactaatgcgggttctcggccctatgttgccaccagcaactgcacagctctgtctgtttgacccaagagcagtagctggtctgtacatttccttgtatgatcataagttgcccgccaatcgaatcgatttgcgtggacaacttaacttataacattttaagtaaaatcatgcattttaggcagacagacatctcactttttagtatatattccttcttctagaggattatttggtgtgtgtctgcgtgtgaccgtgtgtgtttattgaaaggaaacagttccgtgtttagagttttgggttgttagttagaggtctagttaagctataaaattacagtggaataagtgatgacagccagttagtacagttccctcttatagctgaactgagcttaacacaccaacagaaatgtttggcaaatagactgctaaaatgactctttcctttgtggggacataagttgcctgacatttacatgtttataatgagtcctggaagtagaaatgaaaatatgtgcagaaaatagatttctatcatcacttccttttcttattgagggtagcattgtccagtacgtttttgtcatctctgtgctttcttgttgtccacccatacaggaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggatgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttatattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatgg

SEQ ID NO: 89 - DNA, 1633 bp, Homo sapien
atcaatgaacccgcaatcatgaaacttctgacaccaccaggagctgactcacacctgaacagtacaccgtcgaagcttcgacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatgg

SEQ ID NO: 90 - DNA, 857 bp, Homo sapien
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgc

SEQ ID NO: 91 - DNA, 876 bp, Homo sapien
tgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttgccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgc

SEQ ID NO: 92 - DNA, 2396 bp, Homo sapien
cagatctcaattatctaattgcaattgcaacgagaaccaaagcaggggagcagagacaaacaatttctgaggtaaccagatggctttattaactcaagttctcacctaaaattgccctcaagaatcctgtgggaatgggttgcagtggtgtggccctggattcacaaccgacagagcttctgaattctgagtgatctgtacacaaacacacctctgcctgggttacacgcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaa

SEQ ID NO: 93 - DNA, 1813 bp, Homo sapien
cagatctcaattatctaattgcaattgcaacgagaaccaaagcaggggagcagagacaaacaatttctgaggtaaccagatggctttattaactcaagttctcacctaaaattgccctcaagaatcctgtgggaatgggttgcagtggtgtggccctggattcacaaccgacagagcttctgaattctgagtgatctgtacacaaacacacctctgcctgggttacacgcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaa

SEQ ID NO: 94 - DNA, 1843 bp, Homo sapien
cagatctcaattatctaattgcaattgcaacgagaaccaaagcaggggagcagagacaaacaatttctgaggtaaccagatggctttattaactcaagttctcacctaaaattgccctcaagaatcctgtgggaatgggttgcagtggtgtggccctggattcacaaccgacagagcttctgaattctgagtgatctgtacacaaacacacctctgcctgggttacacgcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgatgtgagtatcatcttctttattcctgtgttcaggaatgtagtctatcatgcctcaatgaattaaatatatttcatcacctttttatccacttacagatcaaccaaatggttcgctgctgccgttaattttgtcctccctgtcactcacatgcatcttgcttgtttgtatatttatgcctcttatcaaattgttctgcctaaaatatctcccctctttcttataattcttatttattatctacttggtggttacttagtttgtgcatatatgctcccctatgatatttataatttacacaaataaaagtctgttaaaaaagactgtaactgatatgattaaaatattttgttgaaactttaatatattatagtgaggt

SEQ ID NO: 95 - DNA, 2387 bp, Homo sapien
cagatctcaattatctaattgcaattgcaacgagaaccaaagcaggggagcagagacaaacaatttctgaggtaaccagatggctttattaactcaagttctcacctaaaattgccctcaagaatcctgtgggaatgggttgcagtggtgtggccctggattcacaaccgacagagcttctgaattctgagtgatctgtacacaaacacacctctgcctgggttacacgcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaa

SEQ ID NO: 96 - DNA, 1528 bp, Homo sapien
cggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactg

SEQ ID NO: 97 - DNA, 748 bp, Homo sapien
tcgccctttcgagcggcgcccgggcaggtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatga

SEQ ID NO: 98 - DNA, 2221 bp, Homo sapien
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagagggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcaaaaaaaaaaaaaaaaaaaa

SEQ ID NO: 99 - DNA, 1683 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccggaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcag

SEQ ID NO: 100 - DNA, 1735 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcag

SEQ ID NO: 101 - DNA, 1961 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcagaaaaaaaaaaaaaaaaaaaaaaaaaaaaaaaaaaaaaaaaaaaaaaaaaaaaacatacaaaaaataaaagaatagtcaacaaacaaaataagaaactatagataatataaaaatgaaaataaaaaagagatggggtggggcccttgtctttactctctccctctggagtgggcacactatattatttcgccctccccctctttttttgtatgagagggctctttta

SEQ ID NO: 102 - DNA, 1916 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcagaaaaasaaaacacatcaacccaacaaacgtttggggtattccatggccaataccgttgttcccgtgtgtgaacattgttatttcagctcacatttcccacagtattggaacaacacatcataccacacacacacagaaccaatcgagatatataaacccaatgcacactcaaacacctaat

SEQ ID NO: 103 - DNA, 1735 bp, Homo sapien; identical to SEQ ID NO: 100

SEQ ID NO: 104 - DNA, 1821 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcagatggtgtgccaactgctgtcctctacccggctaccagggggctcagaaacctgcccctcgacccagtcacagcctcatggaacctg

SEQ ID NO: 105 - DNA, 1831 bp, Homo sapien
gatctcttccaaatgtccccgctctccccaggctctcccctcccgccacttgccagggctgacctcaccgccatcttaaccgggtgtccacctctctctgcctgcctggtgctggccccgcgtccccatcgccgcgcccgtctgctcccctcagagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcag

SEQ ID NO: 106 - DNA, 2144 bp, Homo sapien
ggcacgaggccagaacacccctatcttctaggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatycagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcag

SEQ ID NO: 107 - DNA, 1243 bp, Homo sapien
cttgtttcaaatttctattaacagtattaacccggcccctgctgtgcccccagcttggctctaaccccagctcacaccagcaccctgcagcccagagcaatggggctggctgcctccttatctccaaccctcccgcttctcctcagtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcag

SEQ ID NO: 108 - DNA, 1811 bp, Homo sapien
gagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatccagagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagagtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaaaaaaaaaaaa

SEQ ID NO: 109 - DNA, 2690 bp, Homo sapien
tgtgagtcaccaaggaaggcagcggcactccactcagccagtacccagatacgctgggaaccttccccagccatggcttccctggggcagatcctcttctggagcataattagcatcatcattattctggctggagcaattgcactcatcattggctttggtatttcagaagtctctgtctggctttcagcaatgaagggtttggttgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgactatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggataaaggccagggatgctgctcaacctcctaccatgtacaggacgtctccccattacaactacccaatccgaagtgtcaactgtgtcaggactaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagacccttcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttccta

SEQ ID NO: 110 - DNA, 1982 bp, Homo sapien
gagaaccaggacacaagctctgtgcagatgccctcagcagagggctccagcctcccactcttggctgaacagctccaacccgtagggttgacctttcttaaaaggtccagttcttgctgtttggctattttaagctctagtcttctggggtttcactcagctggtcctggcttcagcaattgcttccctctgaaggccttgcatagaggccaagcgtgaagtgcagggacttctctgctgtgatgtggcttaagtttccctgacacctgttgagtgtcctcataacttcccttctggtgcccctccccagctcctgagacacagctgcagctacaagtgtgcagtgtcagtgttcaagaaagtgcctggcagaggggctttagaagggtcccctgccttccaaaggagctttggcaggcagagctgctcctgcagcaacactcccatttcctgttcttgcctgctgagtagcacctagatttctaagcctcatctagatactcagatttgattctgggcctttatagcccagttgctgggactgtttcaggagctaggggccatgtggggcagggagagggcacaaaagtagagaagcctgatgttgattcccagggggctggtcagctctgctactgctccttgcagatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggtgaggctgatcttgctgggtcaaggtgatcctgagcccttggcctgtggaatgggggtagagggcaaatggtaacctagcatgctgtgggggatataggatgaggggctgcccgagcctcgggaggggtcctagggagcagatgttgaagaggccagagccctcagtgagctggatgagagggtgagctgtttgaacgccctgagggtacttcctggggcctcgtgtaatggtctcttctgtatgtcccccatcccatctcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcac

SEQ ID NO: 111 - DNA, 1174 bp, Homo sapien
ctctgataaattccccattctgtcttcccatgtgttgtgtctcgtttttttcctcctccttccctcttccttgccccctcttcccctaaaccttacagatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcac

SEQ ID NO: 112 - DNA, 1909 bp, Homo sapien
  misc_feature (1528)..(1528): n=a, c, g or t
  misc_feature (1538)..(1538): n=a, c, g or t
  misc_feature (1545)..(1545): n=a, c, g or t
ctgtgacttcgttggtctgaaaatgcttgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggtgaacaggcagccatcctcagcagcagtcagcaggaactgatcatcaaagaatctcgctctgttgcccaggctggagtgtagtggtgcgatctcggctcactgaaacctccgcctcccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggagcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaagggcccaacgggnccccaacggnaaatttntgaaaaggggaaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaa

SEQ ID NO: 113 - DNA, 1607 bp, Homo sapien
ctgtgacttcgttggtctgaaaatgcttgcacagtattgtgtccagaattggttccttccggtgggttcttggtctcactgacttcaagaatgaagccacggacccttgcgtcacaagcacctcttcggcaaagcccacctccctctctcgcttgattccccggccatccttatcaaagaccttccaggttcaagcgattctcctgcctcagtctcccgagtagctgggactacagtgatttcctgaaggaaatataatgatctgttcatcgaagtagaagatattgttggccacgtgggatcgaagaccaaaaacatgcagcgtctgagctaccacggctgacatgatctcccgccaaacagttctgctgaagaccaagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaa

SEQ ID NO: 114 - DNA, 1039 bp, Homo sapien
tgtggaattgctttagtaattacataagaatccataatcgacattcgtttgtgttaatgggtacctttagagtagtcattctcttaaactatttttagcaacacccctcccctttttaaaaactagtatacggctacatttcttttagatactaaatcagtgagacagtttttgtttgtttgttcttgctaatggaggtcagattttgagagtccttctgagcttggataactcatgattggcggtgaaaaggaacgtaaggcctcctccttcacctcattacacattttgtcctacgattctcagcctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaa

SEQ ID NO: 115 - DNA, 4254 bp, Homo sapien
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggatctgcagtacagtgttgaatagaactggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 116 - DNA, 4018 bp, Homo sapien
tcaatactgttagttgagatgtggaccatctatcagtttgtaattaagaaaaagtctggcacgtgactgaaactgaggaagaagtagaaaaggcaaaaggtcaaaggtctcatgggaaggaaggagggtagagacagtgagttttattggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcactctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagccaagattaatcaatcaatc

SEQ ID NO: 117 - DNA, 893 bp, Homo sapien
cacaggcccagcagcacacactgtgatcttcaacctgctttatttgtttcaagtttgccgtttaaaaggcaacttgctctagaagggcatttgctttcctctcttcctctagacacacccaccaaaacacaaggagaggccctgaaaagtaactggaaagtcacagaccgttctggcaagtggagttgatgagaaacaggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaaaaaaaaaaasmacaamacaaccaamasaaacatttgcgggcggcctggcgcccacaaagaagccttccaacccaacccggtgcgccgcggggccccgatggtaagtaaaccgtggcaaccggtccaaggaaacccggccagacaaggcggggcccccaaaaaaaagcccggggacgcgcctgccaccaaggctcggcccggcccacggggccggagcgtaac

SEQ ID NO: 118 - DNA, 896 bp, Homo sapien
ttcgatgtgggacagagcacaagctccgagtcactcgggcgttgttatagctagagcttcattccttaaatccagccagggaactgggaagccttactttttctttcaagatcaaatacaggtgtgtggcagagataggtgtaaaattgacacgcacttttaagctgaaacttaagacttctatgatcttttggacttaggggtcccttgaggttggagccccatcctctaggagggccccattgtgtatttccttggtgagtctggggtgtggcctctgggggtcactctgcatgggcaggcctggcccagttgggctgaggcagttttggggtcggctgcctctgtgtgggtgcctggttatcctctgagcccacaatcgaaaaggcagctagttctgtattcatgaagcttaggaactctgtctgaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaactatcggcaggtggggcctgcatgagcatgtggataacccccggggcgccgtggcaccag

SEQ ID NO: 119 - DNA, 1617 bp, Homo sapien
cagacataaacatctcaccaggtccggtgtaacctttcccacggtaacttctaggcctaaaattttctctctgttttttttttttccaagaaaaccacaaaacttttcttaaagtttagattactgattttagacctcttttcttttctcatctaagtatttaaggatagaaacttccccttaagcggatcagcgctgatccgcttaagggggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaata

SEQ ID NO: 120 - DNA, 1916 bp, Homo sapien
atgcccaggctcatcttttcatgaaagtcacaattcacactttttgcttggtaggaaatatttttatattaattctgaaaagctacaaaagtgcatttttacaaacttaggggaagttgaggttcctggggtgagtcctcggttctcccagctttgctctgtaatgcaggtctctgcaagggtccctgtttgtcccctaaggggagagcgcaggttggcctgtgcctccaccccactcccgattcaagctcacagcccaccttttccctgccccatctcagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatgagggactttgctgtgcttcccggagggcttcctggaggagacagcccctagaggtctcacaccttctccccaagcacccgcaggtggtagatgaccacacggccaaaaaagtcagtggcatcctcaaacgtcaccttcagccggtccacttcagcagctggtatggggaaagtgtgagcgtgggcagtcaagggaaactggtgatttctggtttcccacccgcaggcccccaccccttccagacccagctcacactccaccgatgtgggcaacctggggaagctgcaggtccctctaagcctctcacacagaacaggtggtcatcagcaccattttacagaaaaagtggagtcctagaggtcacgtgttcaagatcacacatcagggttcccattcgggtttgggtgagtccaaagcttccagaggcacagaccacccaccccagaagcaggggcaggatatctgaagcgagttgttgtcctcagggtagaaatctacaatcttgtggagagcctgagtgccctgtgaaccttcagcagagaaaggcaatgagtgtctggggtgacccctggaacccctgccacccagggccttctagtaccttccaggcagccccggcgactggagaagccaccctgaaactggatctgcagctgggagacacggatgagctggggaaactccagcgtcacccactgggaggggccctggaagcagacagggaaactgaggcgcaagctcactgcaggcacagagccctgctatgcctgtctcattcacatagttcttggaatggaggggaagaaggaaattcggcacatgttcctttcctggtcgaaaagatgtttttttccaaactgccgagtgttgcgattcagcactgaactcaccctggaggcaccaggatcaaggcgaagagaggggctgagaccagctctcagctccgcggagggcctgacccccagatctgtccactgagggctcgaccccaggcttagggcctcgccactgcctgtccccacagactcttacctgctcactgtctctggacaaaccaaagagtgggtcatgtcggttccacaagacctcgcagggcttaggattgggcacagccttggttcgaatcccggcgcctcctcaagctacagggcggcgcgatcttggctacgccttggcctgaacgtcctcacctgtaacttgggacgagaaccgccactccctcgcccaccccagtcctaaatgtcgcctcgatcaatcccctgccggaaaatttgggagagaggatcagggaaaccgccaatgcccggaggccaggcctttcacaggaaacagatttcccgcgggtttcgggggcggtggctttttgtgcgaggctgtttctctgcgaatagctcttggagccaaatcttgggacc

SEQ ID NO: 121 - DNA, 1627 bp, Homo sapien
atgcccaggctcatcttttcatgaaagtcacaattcacactttttgcttggtaggaaatatttttatattaattctgaaaagctacaaaagtgcatttttacaaacttaggggaagttgaggttcctggggtgagtcctcggttctcccagctttgctctgtaatgcaggtctctgcaagggtccctgtttgtcccctaaggggagagcgcaggttggcctgtgcctccaccccactcccgattcaagctcacagcccaccttttccctgccccatctcagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatgagggactttgctgtgcttcccggagggcttcctggaggagacagcccctagaggtctcacaccttctccccaagcacccgcaggtggtagatgaccacacggccaaaaaagtcagtggcatcctcaaacgtcaccttcagccggtccacttcagcagctggtatggggaaagtctgaagcgagttgttgtcctcagggtagaaatctacaatcttgtggagagcctgagtgccctgtgaaccttcagcagagaaaggcaatgagtgtctggggtgacccctggaacccctgccacccagggccttctagtaccttccaggcagccccggcgactggagaagccaccctgaaactggatctgcagctgggagacacggatgagctggggaaactccagcgtcacccactgggaggggccctggaagcagacagggaaactgaggcgcaagctcactgcaggcacagagccctgctatgcctgtctcattcacatagttcttggaatggaggggaagaaggaaattcggcacatgttcctttcctggtcgaaaagatgtttttttccaaactgccgagtgttgcgattcagcactgaactcaccctggaggcaccaggatcaaggcgaagagaggggctgagaccagctctcagctccgcggagggcctgacccccagatctgtccactgagggctcgaccccaggcttagggcctcgccactgcctgtccccacagactcttacctgctcactgtctctggacaaaccaaagagtgggtcatgtcggttccacaagacctcgcagggcttaggattgggcacagccttggttcgaatcccggcgcctcctcaagctacagggcggcgcgatcttggctacgccttggcctgaacgtcctcacctgtaacttgggacgagaaccgccactccctcgcccaccccagtcctaaatgtcgcctcgatcaatcccctgccggaaaatttgggagagaggatcagggaaaccgccaatgcccggaggccaggcctttcacaggaaacagatttcccgcgggtttcgggggcggtggctttttgtgcgaggctgtttctctgcgaatagctcttggagccaaatcttgggacc

SEQ ID NO: 122 - DNA, 1368 bp, Homo sapien
ccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgaaggttacctctgattatcattcaggatcctcttcttcagatgaagaaacaagtaaggaaatggaagtgaaacccaatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 123 - DNA, 4007 bp, Homo sapien
ctggccccgagcagctgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtaagccttggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgtgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 124 - DNA, 4961 bp, Homo sapien
taggaggccttgataagagtccttggccacattgacatgggggagagagaggaacaggaagctgtgcagatgccaacaggttcgagaaagctctggtggatttactgtccgtgaaagaaacctggggagggcaggagcggctcctcaaaccaatcaaggctgtgtgtggaaagagggaatagtatgtgtgtggaacagtgtgtgtgaaccgcgtgtgtgtggatccactaatgatcctgtgggcttgagattaccttgttgcacagacgaggaaaggaaggtttgggagtttaagtcactgcccgtgatcaatatagagaaggtactaagagaccagaatcaggggtccaaatgcttgtgctggaacagtggcttttctgcttacttgctggtaatcttgggcaaagtgcttaagctcttgtccctgtcttctcatctgtaaaatgggaatatggtgatactcacctcacaatatcgttgtagggactggaggagataactcagagaagatgccaaccatttacagcacatagggaacacagtgccgactaacccactgccaggacagccagtgatgggccactgcctggctgagcgggaaggcaggagagaggcccagggtagctctggaggattgcaggagcaaccgaggcagaagccagtagtcaggctgtccctgccaagggaagggagcatgtgatctaaaatgcttaggagatggatctggattcctggggattatggagagtcttctggggtgggcggctgaaaggaccagtgtcactggctcagcatgaccttgcccaaccaaggcagcttgactgacatgtggccatgtgggtctgggccagaccctttcagccgcagccaccttgtgccaaggcggtgtgatgccaaggccgacggtgtctgtgccagggctgcgggtgttgggtgctgcactggccggcactcctctggctcacctgtctgtccacccttccttgtcttcccagcaagtaacttctaggtctgcagacaagaggaagagaagatgaaggaagactgtctgccgagttctcacgtgcccatcagtgacagcaagtccattcagaagtaagccttggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgtgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctgggggattctgaaggagaatcccaccaagctataggaagcctccctctccgcctcttccagagaaatggatggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 125 - DNA, 4827 bp, Homo sapien
taggaggccttgataagagtccttggccacattgacatgggggagagagaggaacaggaagctgtgcagatgccaacaggttcgagaaagctctggtggatttactgtccgtgaaagaaacctggggagggcaggagcggctcctcaaaccaatcaaggctgtgtgtggaaagagggaatagtatgtgtgtggaacagtgtgtgtgaaccgcgtgtgtgtggatccactaatgatcctgtgggcttgagattaccttgttgcacagacgaggaaaggaaggtttgggagtttaagtcactgcccgtgatcaatatagagaaggtactaagagaccagaatcaggggtccaaatgcttgtgctggaacagtggcttttctgcttacttgctggtaatcttgggcaaagtgcttaagctcttgtccctgtcttctcatctgtaaaatgggaatatggtgatactcacctcacaatatcgttgtagggactggaggagataactcagagaagatgccaaccatttacagcacatagggaacacagtgccgactaacccactgccaggacagccagtgatgggccactgcctggctgagcgggaaggcaggagagaggcccagggtagctctggaggattgcaggagcaaccgaggcagaagccagtagtcaggctgtccctgccaagggaagggagcatgtgatctaaaatgcttaggagatggatctggattcctggggattatggagagtcttctggggtgggcggctgaaaggaccagtgtcactggctcagcatgaccttgcccaaccaaggcagcttgactgacatgtggccatgtgggtctgggccagaccctttcagccgcagccaccttgtgccaaggcggtgtgatgccaaggccgacggtgtctgtgccagggctgcgggtgttgggtgctgcactggccggcactcctctggctcacctgtctgtccacccttccttgtcttcccagcaagtaacttctaggtctgcagacaagaggaagagaagatgaaggaagactgtctgccgagttctcacgtgcccatcagtgacagcaagtccattcagaagtaagccttggtgtgcaggttgggcgggggagtcttcacatttgccatccccctcatcctgggcagcctttaggtggaggggttctgagcacttgttcagagatctgatggggtgccctgggggacagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtccagggcatttactgtgaggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgtgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 126 - DNA, 1969 bp, Homo sapien
gggcttcagtttcgggacgtgctgtgcaggttcctctggtgccctctccaggctgaggaggggctcgggttgtctctggtgattaactccatcattgcctagagagggacgggggcacaccttgacaaatttatgtcctgctttttggcaaataggggagggcaaagagcctcacttgtatcttcttcttctcaattgccagccgctccacttaatccttatgccaaagtggcagatctgggggccctgttctgcctcccttctgcatgagcaggaatctctcagggcagcgctgttagcgagagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 127 - DNA, 2665 bp, Homo sapien
ggtctgcaaagcacagcaccagtgccggctgggaggtctctctcctccatgggcaccagtaccctggtacgggaaggcctgctaaccctagctccccagcatcaccctctggccccctgctcggtattgccaccacgctggggtgacagcttgccaaaacagtgggacacagccccgatcacccatccagtcttggcatcctcaccagcgcaggcatgagctgcagaacacctggcaggaaagtcaggcaggaacccaagtgggcgctgggtcaagcttctgagttctgctggtgatgtggctccaaggagcaggcatgctgaggcagacttggcctgattagggccttttgtcctagtgggaattctgagccttccccaaagtggcagatgctggaactcccagcctcagccgatgttttcaggtgcagagggctagttcaatgaaaaggtgagcaggtctcacctgccagctcctggggacaccacgccagggtccggatgcatgagttagccaggctgtagtcccaatgacgtctccccctcagcaaagtgaagtgtggtccaggacttgtggagggcaccccaccagggctggtggggaggcagctaggaaggaaagggcaggagctcactgagagggcctggggtgtgtggggaaaggatggatgttagcctctggttgaatgacccgtggaaagccacatcctccacaggctcctgtctgtgcagccagaccccaaacaggcagaggagaccaaagtcagagggaatcttccattctgcagtcagtcctgaccccgtaagatttgagagctgaaagggatctggggggcaactagtgggtccactcaacgtacagagtggacgctgaggcccagcacaaggaaggttgccgcataggttatggcagaatctgggctgaaacatgggcttcccgatctctgctctaccgccctgtccactccagtgtgctgttgtctgtattagagtctgcaatagaaatgacaacactctgctctgatgctctgtgcagtccacagcctggtttgactgcacctcatgaggcgcaggccacagccttccccctccttggcagaggagagatgaggctgctgcagggatctcctgagctggccatctgcaggtcccttgctctgctgcccacctccctgccctgtctggcctcagtgagtcctcttggcgatgtctccctccaggttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaa

SEQ ID NO: 128 - DNA, 1835 bp, Homo sapien
gcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgaggagtgcccgggagggaagctgtgcgggcagcagtcctggtttactctcttgagcctgtgcatctctgcacctggagtcaagtccttcccatcagacctcagccctggtgcacccgtgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacga

SEQ ID NO: 129 - protein, 438 aa, Homo sapien
PVPALCPSPWPCPPACPAPSGPPSLNSIPLALFHSEEPHGCFSLAERPSPPKAWDQLRAVSGGSPERRTPWKPPPSDLYGDLKSRRNSVASPTSPTRSLPRSASSFEGRSVPATPVLTRGAGPQLCKPEGLHSRQWSGSQDSQMGFPRADPASDRASLFVARTRRSNSSEALLVDRAAGGGAGSPPAPLAPSASGPPVCKSSEVLYERPQPTPAFSSRTAGPPDPPRAARPSSAAPASRGAPRLPPVCGDFLLDYSLDRGLPRSGGGTGWGELPPAAEVPGPLSRRDGLLTMLPGPPPVYAADSNSPLLRTKDPHTRATRTKPCGLPPEAAEGPEVHPNPLLWMPPPTRIPSAGERSGHKNLALEGLRDWYIRNSGLAAGPQRRPVLPSVGPPHPPFLHARCYEVGQALYGAPSQAPLPHSRSFTAPPVSGRYGGCFY

SEQ ID NO: 130 - protein, 237 aa, Homo sapien [sequence omitted]

SEQ ID NO: 131 - protein, 233 aa, Homo sapien
MPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 132 - protein, 115 aa, Homo sapien
MEKSGRRWLASAAPPLGRLRRRESGAEQGGLSVRATRVSLVRSALDCAPRSGVRRPGSCFCRCRRRIPVARRARLPQACSQHRTEPSGGRGWSARPAWERQGRRCNLLTAKKPGE

SEQ ID NO: 133 - protein, 151 aa, Homo sapien
RNEYQLMLTRYLDFEGLPSKLWHESVRHGFLHSSDNLFFQNGFLLLLLLTNSKHPVLLFVLFVLFCFVLFCLPFRKVLFRVGIDCSLETLSSVCAGSVHALYEFGLNNAFEVTWDVQFWHVFIDCVFKHVSCFMSFSKPHFTSYSEKLIKE

SEQ ID NO: 134 - protein, 699 aa, Homo sapien [sequence omitted]

SEQ ID NO: 135 - protein, 151 aa, Homo sapien; identical to SEQ ID NO: 133

SEQ ID NO: 136 - protein, 762 aa, Homo sapien [sequence omitted]

SEQ ID NO: 137 - protein, 138 aa, Homo sapien
MLANDVRHQQEMWGFRKVEGGVVQSLGKSSVEGETDGTISEFREIQRLAAFASFLSHAPPLNARRLLTPPPRRRPRCTPAAAMADVSERTLQLSVLVAFASGVLLGWQANRLRRRYLDWRKRRLQDKLAATQKKLDLA

SEQ ID NO: 138 - protein, 179 aa, Homo sapien
MPCARAGGLGLQTPNLNGHPRAEPPEGTGGFHFQTGILAASLLPPAEEETLLYILTFCRQVKRRTQTFGDERETKTEPSVQVTASQSRHLTDPTYCLFLNMNDCRSLPETVSEKTATSYFLYVFPIKRLSWVGLRITEGKRSQFQVTQAIFCVKREQDKSQPQQQNPKPPLRLLWQSNT

SEQ ID NO: 139 - protein, 294 aa, Homo sapien
ISVLTWAVFTPPLPSRYFSCAHSTDREAEAGEVRTRLRSYGLPWDLAEDGGRAGPSGLETLTPYSPTPSFTWSDARLHRGLVTLLTGEIVDAFSLEFRTLYAASCPLPPAPPQKPSVIGGLQRGRSLHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRPPWGGALPLPPAHRLRYLSPARRRFGGDATFKLQEPRGVRPSDWAPRAGLGGQP

SEQ ID NO: 140 - protein, 294 aa, Homo sapien
ISVLTWAVFTPPLPSRYFSCAHSTDREAEAGEVRTRLRSYGLPWDLAEDGGRAGPSGLETLTPYSPTPSFTWSDARLHRGLVTLLTGEIVDAFSLEFRTLYAASCPLPPAPPQKPSVIGGLQRGRSPHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRPPWGGALPLPPAHRLRYLSPARRRFGGDATFKLQEPRGVRPSDWAPRAGLGGQP

SEQ ID NO: 141 - protein, 90 aa, Homo sapien
MALQLSREQGITLRGSAEIVAEFFSFGINSILYQRGIYPSETFTRVQKYGLTLLVTTDLELIKYLNNVVEQLKVHPEKSLRKLSRMKSVQ

SEQ ID NO: 142 - protein, 373 aa, Homo sapien
RTVTVRTRIAVLSLRPQCGGILFRHVVVLTLGNGLGQNLDLASVQAHAAVQGRRVLIPGVNIRQENLGRGRFHDHVQDAAVGGVGQALRCHQHKAVGLTQHLEPFPDLRAECRVAEHQPGFVQDDERPPVWWNSNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 143 - protein, 148 aa, Homo sapien
GGLSPIHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 144 - protein, 72 aa, Homo sapien
MVLSSPLALAGDTQPRFLWQDKYGVSFLQRDGAGAVSWKECIYNQEEFVRFDSDVGEYRAVTELGRPVADPS

SEQ ID NO: 145 - protein, 191 aa, Homo sapien
DSPAPLAPGPVLFSSMVCLKLPGGSCMAALTVTLMVLSSPLALAGDTQLHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 146 - protein, 112 aa, Homo sapien
MVLSSPLALAGDTQLHPEVTVYPAKTQPLQHHNLLVCSVSGFYPGSIEVRWFRNGQEEKAGVVSTGLIQNGDWTFQTLVMLETVPRSGEVYTCQGGAPKCDEPSHSGMESTV

SEQ ID NO: 147 - protein, 128 aa, Homo sapien
GFRGPAHWPLPTGLHLTPPSLSVPSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 148 - protein, 256 aa, Homo sapien [sequence omitted]

SEQ ID NO: 149 - protein, 250 aa, Homo sapien
GSAAARYLSATWRNWISLPPAGLPATAGLRHSGSLMAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGTGWEVCPESQQRG

SEQ ID NO: 150 - protein, 402 aa, Homo sapien
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGTGWEVCPESRSVVEQRVGRQGTYSDPAPRTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 151 - protein, 219 aa, Homo sapien
MSLPVKPELLGDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 152 - protein, 172 aa, Homo sapien
MKETCQLEIQVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 153 - protein, 329 aa, Homo sapien
SGDLQPHSRCPGGRRDPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 154 - protein, 595 aa, Homo sapien
MVCLFLKCNLQNSPERNNSFWEVVAAAGTVAPWEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDADPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 155 - protein, 85 aa, Homo sapien
ALSVVAAEVRVVGRNGESSELDLQGIRIDSDISGTLKFACESIVEEYEDELIEFFSREADNVKDKLCSKRTDLCDHALHISHDEL

SEQ ID NO: 156 - protein, 255 aa, Homo sapien
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGVAAAAAVFFTSIIRLAFNKEKVLTPVLNCT

SEQ ID NO: 157 - protein, 174 aa, Homo sapien
MAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYLPGRPAWSRPRYSDSVGRVSFPSLVCFLMRLEAMAKTFRNSLRMEKDST

SEQ ID NO: 158 - protein, 354 aa, Homo sapien
MGQDWGPHHMSREDLICGGGKGSLVWPTWSTTSLWPQVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 159 - protein, 489 aa, Homo sapien
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGRLPGLRLCVRAIPGTLRASPGTSVPFPHRLLEPLLVHPCALPGGPGLAGYF

SEQ ID NO: 160 - protein, 287 aa, Homo sapien
MDMAWQMMQLLLLALVTAAGSAQPRSARARTDLLNVCMNAKHHKTQPSPEDELYGQVGAPQGPSPGSVPLDDLPGAEEPEYGGDGCGGERLSPVSSPPSAVPGRRMPAARPAPARSCTRTPPACTTLTGITVVRWNPPASATLSRTAVSECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 161 - protein, 143 aa, Homo sapien
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQDILPLLLGWVVCASGSFGLTQTRMGTLMCDLEHVTSRTPLFL

SEQ ID NO: 162 - protein, 116 aa, Homo sapien [sequence omitted]

SEQ ID NO: 163 - protein, 67 aa, Homo sapien [sequence omitted]

SEQ ID NO: 164 - protein, 104 aa, Homo sapien
GWTGCVRISGAGRSRILQALARKPEDPPLPRTRKSSSCLLSSLWQELRALELLGPSQGLPYLKPQLGPLSPPGMRPRAPLTRRPRSLTLIFHRVQEFIRTPKSE

SEQ ID NO: 165 - protein, 82 aa, Homo sapien [sequence omitted]

SEQ ID NO: 166 - protein, 360 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRRSRTRWWHGGKVMWQPVTPTPAWPKRSWGGQQP

SEQ ID NO: 167 - protein, 376 aa, Homo sapien
RARGSGVGGGASAASVGRGNPSRTLQSSVTLDKEVWILRFHLFQLQGAMAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRR

SEQ ID NO: 168 - protein, 466 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRRSGPPTPPTSPTSPHPALSNRAALALPTHLSGGYLALPSLLSLPSTRCLRASRCSALLLLKDLASSWARAGSAKLQLPPVLQIPYKVVARREGDVAACYANPSLAQEELGWTAALGLDRMCEDLWRWQKQNPSGFGTQA

SEQ ID NO: 169 - protein, 328 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRR

SEQ ID NO: 170 - protein, 178 aa, Homo sapien
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQQHNQQLGRRSC

SEQ ID NO: 171 - protein, 141 aa, Homo sapien
LQARLLSAKGEIWMASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEVTTLNHKLQDA

SEQ ID NO: 172 - protein, 188 aa, Homo sapien
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEVTTLNHKLQDASRPGFLFSVAPPLQTRLRRENQVLSVRIADKKYYPSSQDSSSAAAPQLLIVLLGLSALLQ

SEQ ID NO: 173 - protein, 78 aa, Homo sapien
MPWIGGGLIAVWGGAINGGGSIDGGEGLMDGWGGSSDGGGAWGRAWSGASACCLQSALSPSSGPLGTSWKVRPARLFA

SEQ ID NO: 174 - protein, 116 aa, Homo sapien
MLWVWFHITAIKLQREEEEAFASSQSSQGAQSLIFSKFEGKKTNKKTRKVTTVKKSSVRLPGSDQRRILKWIPGVCLETSWPASPSAASTSSMPSRSPRTSWRQQMTSSPPSSTLF

SEQ ID NO: 175 - protein, 360 aa, Homo sapien
MATKGGTVKAASGFNAMEDAQTLRKAMKGLAQTTRKQKIHQTFMNSQLLERQGTNLKNQNKVSLLKLLQETGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 176 - protein, 177 aa, Homo sapien [sequence omitted]

SEQ ID NO: 177 - protein, 380 aa, Homo sapien
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECRNKTDLSRRSLLDAGSIKGESILLFPVAEEKEKYHEEG

SEQ ID NO: 178 - protein, 394 aa, Homo sapien
ELRLLSYFRLVCFPSGREALVPFPRLSCHFSGGRSVNELIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFL

SEQ ID NO: 179 - protein, 679 aa, Homo sapien
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFLLKTGQFLAVWQEETAGVHFTGSWARCRQFPGALQVLQKYRAKSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 180 - protein, 72 aa, Homo sapien
  MISC_FEATURE (45)..(45): X=any amino acid
RCNTPTSSQIKFQHILYASVTKQPHNLVFIVDLYRMKEENPLWHXNESFWWGQLTRPRGQRSRSESRPTRPW

SEQ ID NO: 181 - protein, 77 aa, Homo sapien [sequence omitted]

SEQ ID NO: 182 - protein, 174 aa, Homo sapien
SKCHVYTLNILKICFFYFRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 183 - protein, 36 aa, Homo sapien
MQERNGCCEIPLRNYIIQVMKITQFYFQRRTDEKGL

SEQ ID NO: 184 - protein, 215 aa, Homo sapien
  MISC_FEATURE (207)..(207): X=any amino acid
  MISC_FEATURE (211)..(211): X=any amino acid
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALAEIGPPPNFFXPFSXKFFF

SEQ ID NO: 185 - protein, 133 aa, Homo sapien
ILCIKFFKSQSFFFLINWMYFTEFPTAHVSFLPFRVDLSNVLDLHAFDSLSGISLQKKLQHVPGTQPHLDQSIVTITFDVPGNAKEEHLNMFIQNLLWEKNVRNKDNHCMEVIRLKVQFTVADFWTKSFSWLL

SEQ ID NO: 186 - protein, 953 aa, Homo sapien [sequence omitted]

SEQ ID NO: 187 - protein, 194 aa, Homo sapien
ILCIKFFKSQSFFFLINWMYFTEFPTAHVSFLPFRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 188 - protein, 728 aa, Homo sapien [sequence omitted]

SEQ ID NO: 189 - protein, 312 aa, Homo sapien
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGNPARPLPPPTLLALAPL

SEQ ID NO: 190 - protein, 182 aa, Homo sapien
MQPLLHSHSGPPCDNTGCPSVSGSAPFTLMCCLDGDCMITVIMRGPQALGVLSPLELICPYICCPGPRHPTDHIQAPCSGPTGLWWTWGGARLLTLKGQRWQPEKPEDIPLHPSLSASDTTGWGVSPRGAGYLFGSDVVAQFNAANDIDMICRAHQLVMEGYKWHFNETVLTVWSAPNYCYR

SEQ ID NO: 191 - protein, 293 aa, Homo sapien
VPSQALGSGSRRHRCPGRRASCLPPRPPRCWPPGRVAAMLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSEPALSKGVENLQALLYQAATGSSEASFPTLSPL

SEQ ID NO: 192 - protein, 635 aa, Homo sapien [sequence omitted]

SEQ ID NO: 193 - protein, 166 aa, Homo sapien [sequence omitted]

SEQ ID NO: 194 - protein, 305 aa, Homo sapien
GLKETHRPAKGPSLLPIHPGWPAFLLPDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 195 - protein, 194 aa, Homo sapien
KKREGGREKKGSGALIIVWVSISFLQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 196 - protein, 241 aa, Homo sapien
MATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKAMTSHLWILLQFMC

SEQ ID NO: 197 - protein, 261 aa, Homo sapien
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQVMNPLGKPLCPCPQPSLTLLLEKLKCSPSLPITIDSPKQLPPPHFHLLVFSYRGSLFLSLIWCH

SEQ ID NO: 198 - protein, 499 aa, Homo sapien
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISSEWASERVGMYGGRLSQWPPLCPQAFGSHPSILRAPGVGVGEDASVRSGALGSS

SEQ ID NO: 199 - protein, 344 aa, Homo sapien [sequence omitted]

SEQ ID NO: 200 - protein, 479 aa, Homo sapien
RNQGEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGEILPRCPGSGQTLTLPSSLFPSSSA

SEQ ID NO: 201 - protein, 121 aa, Homo sapien
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 202 - protein, 149 aa, Homo sapien [sequence omitted]

SEQ ID NO: 203 - protein, 121 aa, Homo sapien; identical to SEQ ID NO: 201

SEQ ID NO: 204 - protein, 149 aa, Homo sapien [sequence omitted]

SEQ ID NO: 205 - protein, 101 aa, Homo sapien [sequence omitted]

SEQ ID NO: 206 - protein, 95 aa, Homo sapien
WIARAGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 207 - protein, 109 aa, Homo sapien
MHARAAQCDGSVVAADPGDGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 208 - protein, 1485 aa, Homo sapien
MQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGHHTLQRQSTT

SEQ ID NO: 209 - protein, 111 aa, Homo sapien
  MISC_FEATURE (11)..(12): X=any amino acid
KKRKERKRENXXTIGTGSLMHARAAQCDGSPGRCVLVDGYSPNRNEPLTGNSDLPFWAVILIGLAGLLGLITCLICGVLVTTRRRKKEGEYNVQQQCPGYYQSHLDLEDLQ

SEQ ID NO: 210 - protein, 87 aa, Homo sapien
MRGRGRPGRCVLVDGYSPNRNEPLTGNSDLPFWAVILIGLAGLLGLITCLICGVLVTTRRRKKEGEYNVQQQCPGYYQSHLDLEDLQ

SEQ ID NO: 211 - protein, 92 aa, Homo sapien [sequence omitted]

SEQ ID NO: 212 - protein, 83 aa, Homo sapien
MHPPGFLSFLGYSPNRNEPLTGNSDLPFWAVILIGLAGLLGLITCLICGVLVTTRRRKKEGEYNVQQQCPGYYQSHLDLEDLQ

SEQ ID NO: 213 - protein, 225 aa, Homo sapien
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDWGSTYSVSVVETDYDQYALLYSQGSKGPGEDFRMATLYSRTQTPRAELKEKFTAFCKAQGFTEDTIVFLPQTDKCMTEQ

SEQ ID NO: 214 - protein, 349 aa, Homo sapien
RRHSSRSSCSGPPRPGHLPRSPTPLAPGPGHPLCCRRMATHHTLWMGLALLGVLGDLQAAPEAQVSVQPNFQQDKVRGFPASSPRATGPCQGKGTFRLGLPPGRSERSPAVPGSAGQGLSGRAGRRLGSRPRRLPARSPPWAPRPVSPDGPRRHRATHAPTPARHVHPCGHATPRGHTSARSTPGCQDTGGWGTGMATNTPCAVGVGRDAHRTDSRRRALSPGSCSGKRRSAGPRAARPSLASRRTPAVRRAEPKTRPDPRQECDVLCRPLYGPGAQPGHRIGTGGGGAEAGWWAACEVPGALVQRGPRLQLELAPGEEGGVVHVQVCGGPCHGWWPQPDLHLPQEKPV

SEQ ID NO: 215 - protein, 413 aa, Homo sapien
MATHHTLWMGLALLGVLGDLQAAPEAQVSVQPNFQQDKVRGFPASSPRATGPCQGKGTFRLGLPPGRSERSPAVPGSAGQGLSGRAGRRLGSRPRRLPARALPGHRVPSPLMGHADTGPHTRPRQPDTSTPVGTRPPEDTRAHVPHLGARTRAGGAQGWRQTLRARWGLGGTRTAQTAGDARSRPGAARGSAGARVPAPRAPPWRRGEPQRSAELSRRPAPIPARNATSSAARCMGQALSQGTESGPGAEGPKLAGGRRARFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 216 - protein, 410 aa, Homo sapien
MATHHTLWMGLALLGVLGDLQAAPEAQVSVQPNFQQDKVRGFPASSPRATGPCQGKGTFRLGLPPGRSERSPAVPGSAGQGLSGRAGRRLGSRPRRLPARSPPWAPRPVSPDGPRRHRATHAPTPARHVHPCGHATPRGHTSARSTPGCQDTGGWGTGMATNTPCAVGVGRDAHRTDSRRRALSPGSCSGKRRSAGPRAARPSLASRRTPAVRRAEPKTRPDPRQECDVLCRPLYGPGAQPGHRIGTGGGGAEAGWWAACEGEGLSSGGAWPDGGAGCQGRGQLLGRRCEGRGHLLGRGLRGGGQFLGRGVRGVAARGIGRGGGAGLETGGVDGRGAPAGRRRWVRRVLADAGGGRSPQFPGALVQRGPRLQLELAPGEEGGVVHVQVCGGPCHGWWPQPDLHLPQEKPV

SEQ ID NO: 217 - protein, 135 aa, Homo sapien
MAAGPMAAEPCGPHALVALAGLVTGIPTHHPRVYNIHSRTVTRYPANSIVVVGGCPVCRVGVLEDCFTFLGIFLAIILFRIGPAAIGQWQPPNGSRTQTPRAELKEKFTAFCKAQGFTEDTIVFLPQTDKCMTEQ

SEQ ID NO: 218 - protein, 150 aa, Homo sapien
ALLEAWARDRGVSVQVRTSLPQPLHEEPPPWGTWRPGAHSVPGPSSSQDVGLQPGGGHRVEGAHGGYRGTNHTGLRHSLLGVDSLLLAEVEKDPLFVSSAQGEVGGDGGSVQFGGSVKTSSALREEQEAQWENWPKSGVLTTAPGFFLGR

SEQ ID NO: 219 - protein, 224 aa, Homo sapien
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGDWGSTYSVSVVETDYDQYALLYSQGSKGPGEDFRMATLYSRTQTPRAELKEKFTAFCKAQGFTEDTIVFLPQTDKCMTEQ

SEQ ID NO: 220 - protein, 481 aa, Homo sapien
MATHHTLWMGLALLGVLGDLQAAPEAQVSVQPNFQQDKVRGFPASSPRATGPCQGKGTFRLGLPPGRSERSPAVPGSAGQGLSGRAGRRLGSRPRRLPARSPPWAPRPVSPDGPRRHRATHAPTPARHVHPCGHATPRGHTSARSTPGCQDTGGWGTGMATNTPCAVGVGRDAHRTDSRRRALSPGSCSGKRRSAGPRAARPSLASRRTPAVRRAEPKTRPDPRQECDVLCRPLYGPGAQPGHRIGTGGGGAEAGWWAACEGEGLSSGGAWPDGGAGCQGRGQLLGRRCEGRGHLLGRGLRGGGQFLGRGVRGVAARGIGRGGGAGLETGGVDGRGAPAGRRRWVRRVLADAGGGRSPQFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDGCPTSVRGKGQAWA

SEQ ID NO: 221 - protein, 1088 aa, Homo sapien
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKVYAALPASRRRGAHEAQGRVDRIVSVTCETRVSRWGFSTTPYEAQLRDDSSVRPPGGPRLGRHCQMAPG

SEQ ID NO: 222 - protein, 440 aa, Homo sapien
RVGKAGGGDPGGGGRSPALRQKVPRLHTRARSQRAAGADGRRGGRRQGRSVYSCSGAVSWRRLGRLLSPGSAAAAKAAAPALSLSLSRLWLQVKGKQARMDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQPPM

SEQ ID NO: 223 - protein, 521 aa, Homo sapien
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQPPDVTVLLREPVRAPAVAVAPTPVQPPIIVAPVATVPAMPQEKLASSPKDKKKKEKNVAKVEPAVSSVVNSIQSSHFEGCQVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAR

SEQ ID NO: 224 - protein, 165 aa, Homo sapien
GRSQRSSPCSAPLQGPGALGLRTQLLLPPWSSTWEQVSSWGVWTGGAGGRTQAQKLPAPTTQLLSTALEPTSQKPGVGAGHGGDPKLSPHKVQGRSEAGAGPGPKQGHHSSSDSSSSSSDSDTDVKSHAAGSKQHESIPGKAKKPKVKKKEKGKKEKGKKKEAPH

SEQ ID NO: 225 - protein, 262 aa, Homo sapien
GRSQRSSPCSAPLQGPGALGLRTQLLLPPWSSTWEQVSSWGVWTGGAGGRTQAQKLPAPTTQLLSTALEPTSQKPGVGAGHGGDPKLSPHKVQGRSEAGAGPGPKVSRLITGCGGAGRLGLPLTPGSCLRPPTSGGWVRGAASLPHLHPARTPQLFRLQQQLQRFGHGCEGKGLSPASPSTCPAPQRGVPALGLAGRVRGVVPLSRFQPRTISSLPSLPSAPQSHAAGSKQHESIPGKAKKPKVKKKEKGKKEKGKKKEAPH

SEQ ID NO: 226 - protein, 231 aa, Homo sapien
  MISC_FEATURE (206)..(206): X=any amino acid
  MISC_FEATURE (210)..(210): X=any amino acid
SRDPNGWWRRLRVSAELAMAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFQGNXPALXQGGPGGGPRGDPSGRPGDRTG

SEQ ID NO: 227 - protein, 213 aa, Homo sapien
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFQRELPWPWAKGGRGAARGGTPRGAQGTEP

SEQ ID NO: 228 - protein, 242 aa, Homo sapien
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKGKWPLTLLLPSACLLPSLTELSPAQLWFTLSFTVNIILAESHVSA

SEQ ID NO: 229 - protein, 53 aa, Homo sapien
RFWLAIGCWPSRQSREQHISSRRKMEILKTECQEKESRTIHSMRRKMEKKNFI

SEQ ID NO: 230 - protein, 43 aa, Homo sapien
MDRPPGQVPGHLGQCDVSGWQSDAGPAGSQENSTLVPEERWKF

SEQ ID NO: 231 - protein, 66 aa, Homo sapien [sequence omitted]

SEQ ID NO: 232 - protein, 34 aa, Homo sapien
MDRSRPRYLAILGSVTFLAGNRMLAQQAVKRTAH

SEQ ID NO: 233 - protein, 116 aa, Homo sapien
  MISC_FEATURE (3)..(4): X=any amino acid
  MISC_FEATURE (10)..(11): X=any amino acid
  MISC_FEATURE (31)..(31): X=any amino acid
  MISC_FEATURE (34)..(34): X=any amino acid
  MISC_FEATURE (39)..(39): X=any amino acid
  MISC_FEATURE (41)..(41): X=any amino acid
  MISC_FEATURE (44)..(44): X=any amino acid
  MISC_FEATURE (57)..(57): X=any amino acid
  MISC_FEATURE (59)..(60): X=any amino acid
  MISC_FEATURE (65)..(66): X=any amino acid
  MISC_FEATURE (69)..(69): X=any amino acid
  MISC_FEATURE (71)..(71): X=any amino acid
  MISC_FEATURE (75)..(76): X=any amino acid
  MISC_FEATURE (80)..(81): X=any amino acid
  MISC_FEATURE (83)..(83): X=any amino acid
  MISC_FEATURE (97)..(97): X=any amino acid
  MISC_FEATURE (115)..(115): X=any amino acid
MVXXRPSPLXXDLNAPSDWDSRGKDSYETRXLDXKSAEXKXKKXSRLYKRKANDESXEXXDVIDXXELXKXSREXXSHEXXSXEDMLVVDAKSKEEXKHLKFRISHELDSASSEXN

SEQ ID NO: 234 - protein, 122 aa, Homo sapien
  MISC_FEATURE (9)..(10): X=any amino acid
  MISC_FEATURE (16)..(17): X=any amino acid
  MISC_FEATURE (37)..(37): X=any amino acid
  MISC_FEATURE (40)..(40): X=any amino acid
  MISC_FEATURE (45)..(45): X=any amino acid
  MISC_FEATURE (47)..(47): X=any amino acid
  MISC_FEATURE (87)..(87): X=any amino acid
MESEELNGXXKAIPVXXDLNAPSDWDSRGKDSYETRXLDXKSAEXKXKKKSRLYKRKANDESKEQADVIDRKELAKDSREANSHEFXSKEDMLVVDAKSKEEEKHLKFRISHELDSASSEFN

SEQ ID NO: 235 - protein, 86 aa, Homo sapien
LSGLFRSLEVIFVIFFLNYFRELGMQMFSVRKPLFTLWKLNKKCICLRNWRLLMLGNTCNGSRGNCVSVFGNEIYGKPFFKLVMLL

SEQ ID NO: 236 - protein, 30 aa, Homo sapien
KSGINAEGPLRPGAAILGLLGLASVGDSRT

SEQ ID NO: 237 - protein, 125 aa, Homo sapien
  MISC_FEATURE (70)..(70): X=any amino acid
  MISC_FEATURE (84)..(84): X=any amino acid
  MISC_FEATURE (92)..(92): X=any amino acid
QRLQRVAGITGTCHHTQLIFIFLVETGFHHVGQAGFELLIWWSACLGLPECWDYRRKPPRLAKKIKIYLXYVLTSYTQRILDFXLKIIIKPXISPVEKEILRFLCFFFQHNSVTYGWEKICREII

SEQ ID NO: 238 - protein, 104 aa, Homo sapien
TRTQRGTIGQNISHTHQRHTKPPTHAITRPLIRTLAEPDWKSTRSTKYIGNPPHRNPKLDKAKITATTPINKKPNTRHTRNPPPNRRPMPIHQQTHTKDKKRHE

SEQ ID NO: 239 - protein, 61 aa, Homo sapien
MHQGREHSAQTIDSDYLLTVCRRHAGGLKRGCILLPSLAGYGISSFPFIGYEVYSSIYQNL

SEQ ID NO: 240 - protein, 193 aa, Homo sapien [sequence omitted]

SEQ ID NO: 241 - protein, 163 aa, Homo sapien
SGGFTLRSTGSAAGRGLRKLRPTLSRGACDVGRSVWKLRPSHCRVGRGARGIFHAPPLCRLKCVGGKRWAGCHLAPPFSCGVGQAAASSSCSSHRLHSDPSPAAWILLPRRGSFSRNLRARPQSVPAASRRTRWLQASLTPGFLAKRETEGERGEDERTGNGR

SEQ ID NO: 242 - protein, 227 aa, Homo sapien
  MISC_FEATURE (3)..(4): X=any amino acid
FFXXKEAGPPGLKTHAGVGPFWPVGFLKPQWRALSSSFSQNPPGGLPLHSFPNSGLPRRHRETLFGLPSKSRAMLKHPWGPQPFSPSVPAKEPQGPGGHGARFRVAKKSLVPNQGASQGALLKTLSPTVIWRGVNAGGKPPRPHQRGFQKEQPARGPRLRNNRRETTGWAEPRVKYPWLPARDGDRRRAWCCTWCYWCARKKYPGLVLEVPRDKLTAAGMKTDEGPH

SEQ ID NO: 243 - protein, 198 aa, Homo sapien
MACPFELLFSKPPWGPSPPLLPKFWSPQKTQGNIVWSAQQIKGNAQTPMGAPTLQPVRARQRTPRPWGTWGSLQSCQKKPCAKSGGLPRGSVENIVPYGDMEGGQCRGEATKATINGDSRRSSQQGAHGYEITAEKPPVGRNRVSNTLGCPQGTGTGAEHGAVLGVTGVLRKKYPGLVLEVPRDKLTAAGMKTDEGPH

SEQ ID NO: 244 - protein, 103 aa, Homo sapien
PKDAPEKLENLFQVGRRVGDTKITLLYRTLQLSMQEIPFSLSAPGKTQQPTEAIGDSLSTRGMFSKQGVPCLSNKCPPSLLGFLFLQLVVSKPLPGIVKALPK

SEQ ID NO: 245 - protein, 65 aa, Homo sapien [sequence omitted]

SEQ ID NO: 246 - protein, 103 aa, Homo sapien; identical to SEQ ID NO: 244

SEQ ID NO: 247 - protein, 27 aa, Homo sapien
MKLLTPPGADSHLNSTPSKLRRSPAKN

SEQ ID NO: 248 - protein, 154 aa, Homo sapien
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRVSGLVPPPFWGCWAE

SEQ ID NO: 249 - protein, 176 aa, Homo sapien
LVQAVCGSELRLAWPPGLRVIGPSVAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 250 - protein, 271 aa, Homo sapien [sequence omitted]

SEQ ID NO: 251 - protein, 268 aa, Homo sapien
MKSVIFQFGIKVSFSVAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 252 - protein, 342 aa, Homo sapien
METKHLGRGGAGRAGPHLWRGPRPNCSAGAGGGEPTHSPNSRAVTHQRAPAARECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 253 - protein, 240 aa, Homo sapien
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDDVSIIFFIPVFRNVVYHASMN

SEQ ID NO: 254 - protein, 390 aa, Homo sapien
MAPPQVLAFGLLLAAATATFAAAQEGEARIGAELWSWAGLGGSGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 255 - protein, 314 aa, Homo sapien
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 256 - protein, 122 aa, Homo sapien
QNLTCAENKMRLAWLYLFFLFCFGFFFFFGLTQDLKTGTVKVTAVGWSEHPPKFTMWPRTLIAHCCFFNSHSKYEMRCYRKSLAILKATPLLSKENGPVLSQVHTGEVIALLSCKLCNAKFF

SEQ ID NO: 257 - protein, 48 aa, Homo sapien
ALSSGRPGRYSVWIGGSILASLSTFQQMWISKQEYDESGPSIVHRKCF

SEQ ID NO: 258 - protein, 596 aa, Homo sapien
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQREELRAVSPEEGARVYSQVTVQRSLLEDKEKVSELEAVMEKQKKKVEGEVEMEVI

SEQ ID NO: 259 - protein, 408 aa, Homo sapien
DLFQMSPLSPGSPLPPLARADLTAILTGCPPLSACLVLAPRPHRRARLLPSEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGRRSCGR

SEQ ID NO: 260 - protein, 470 aa, Homo sapien
MSPLSPGSPLPPLARADLTAILTGCPPLSACLVLAPRPHRRARLLPSEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 261 - protein, 474 aa, Homo sapien
DLFQMSPLSPGSPLPPLARADLTAILTGCPPLSACLVLAPRPHRRARLLPSEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 262 - protein, 474 aa, Homo sapien; identical to SEQ ID NO: 261

SEQ ID NO: 263 - protein, 474 aa, Homo sapien; identical to SEQ ID NO: 261

SEQ ID NO: 264 - protein, 470 aa, Homo sapien; identical to SEQ ID NO: 260

SEQ ID NO: 265 - protein, 502 aa, Homo sapien
MSPLSPGSPLPPLARADLTAILTGCPPLSACLVLAPRPHRRARLLPSEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 266 - protein, 548 aa, Homo sapien
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEDKEKVSELEAVMEKQKKKVEGEVEMEVI

SEQ ID NO: 267 - protein, 277 aa, Homo sapien [sequence omitted]

SEQ ID NO: 268 - protein, 282 aa, Homo sapien
MASLGQILFWSIISIIIILAGAIALIIGFGISGRHSITVTTVASAGNIGEDGIQSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 269 - protein, 59 aa, Homo sapien
MASLGQILFWSIISIIIILAGAIALIIGFGISEVSVWLSAMKGLVVEVPRLPLALIFAS

SEQ ID NO: 270 - protein, 252 aa, Homo sapien
TAGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 271 - protein, 155 aa, Homo sapien
GRGPPGELCHECWQGPRLLQEGRCGHCADRMAPWLRLHQHHACCSCAVMDPRAPPPAPVPPPSPSPSIRPATLVELTLGCNVALVGWDTREEDQRLTETWLCLQPALVGQPRAWLPIMWPHPIKGRRRNAGLEAPGARWQEGDSFLSCVYSVQFL

SEQ ID NO: 272 - protein, 107 aa, Homo sapien [sequence omitted]

SEQ ID NO: 273 - protein, 155 aa, Homo sapien; identical to SEQ ID NO: 271

SEQ ID NO: 274 - protein, 143 aa, Homo sapien
MFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 275 - protein, 253 aa, Homo sapien
  MISC_FEATURE (243)..(243): X=any amino acid
  MISC_FEATURE (245)..(245): X=any amino acid
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPTGPQRXIXEKGKGAQC

SEQ ID NO: 276 - protein, 361 aa, Homo sapien
MYPEALPVGILSNPDTFKRRSGSYSNDKPEVWFAAGSGSPNQKLSSSCVGRACGEMDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 277 - protein, 167 aa, Homo sapien [sequence omitted]

SEQ ID NO: 278 - protein, 636 aa, Homo sapien
PRRGLRVSSPGGPGAMGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKDLQYSVE

SEQ ID NO: 279 - protein, 870 aa, Homo sapien
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKDLQYSVEYELAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRPLLFQASEHVASSPALGDVIPFSIIIQFLFTRAPAELKSPFQRAEWSHTRFSQWLDDHPSEKDRLLLIRGALEAYVQSVRSREGKEFAPVYPIMVQLLQKAMSALQ

SEQ ID NO: 280 - protein, 791 aa, Homo sapien
MGWVGGRRRDSASPPGRSRSAADDINPAPANMEGGGGSVAVAGLGARGSGAAAATVRELLQDGCYSDFLNEDFDVKTYTSQSIHQAVIAEQLAKLAQGISQLDRELHLQVVARHEDLLAQATGIESLEGVLQMMQTRIGALQGAVDRIKAKIVEPYNKIVARTAQLARLQVACDLLRRIIRILNLSKRLQGQLQGGSREITKAAQSLNELDYLSQGIDLSGIEVIENDLLFIARARLEVENQAKRLLEQGLETQNPTQVGTALQVFYNLGTLKDTITSVVDGYCATLEENINSALDIKVLTQPSQSAVRGGPGRSTMPTPGNTAALRASLWTNMEKLMDHIYAVCGQVQHLQKVLAKKRDPVSHICFIEEIVKDGQPEIFYTFWNSVTQALSSQFHMATNSSMFLKQAFEGEYPKLLRLYNDLWKRLQQYSQHIQGNFNASGTTDLYVDLQHMEDDAQDIFIPKKPDYDPEKALKDSLQPYEAAYLSKSLSRLFDPINLVFPPGGRNPPSSDELDGIIKTIASELNVAAVDTNLTLAVSKNVAKTIQLYSVKSEQLLSTQGDASQVIGPLTEGQRRNVAVVNSLYKLHQSVTKVVSSQSSFPLAAEQTIISALKAIHALMENAVQPLLTSVGDAIEAIIITMHQEDFSGSLSSSGKPDVPCSLYMKELQGFIARVMSDYFKHFECLDFVFDNTEAIAQRAVELFIRHASLIRPLGEGGKMRLAADFAQMELAVGPFCRRVSDLGKSYRMLRSFRGALEAYVQSVRSREGKEFAPVYPIMVQLLQKAMSALQ

SEQ ID NO: 281 - protein, 122 aa, Homo sapien
KVTGKSQTVLASGVDEKQAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 282 - protein, 170 aa, Homo sapien [sequence omitted]

SEQ ID NO: 283 - protein, 91 aa, Homo sapien
MKLEELCLKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 284 - protein, 66 aa, Homo sapien
SLCYNVLKPPYYRNIYYIFSICSFSEGLWISLNCQILAYFCDTPAHFLSLINQGVRCDCHNCYVFQ

SEQ ID NO: 285 - protein, 65 aa, Homo sapien
MPQYQTWEEFSRAAEKLYLADPMKARVVLKYRHSDGNLCVKVTDDLVLMRLMVAKEARNVTMETE

SEQ ID NO: 286 - protein, 363 aa, Homo sapien
SRTTSSSSSRATWCPLTLSEGRLPGTQTLREQNGQPELGKPRTDFKGSFWTGGGRGPFPRGTNKPSVQNEGLCCASRRASWRRQPLEVSHLLPKHPQVVDDHTAKKVSGILKRHLQPVHFSSWYGESVSVGSQGKLVISGFPPAGPHPFQTQLTLHRCGQPGEAAGPSKPLTQNRWSSAPFYRKSGVLEVTCSRSHIRVPIRVWVSPKLPEAQTTHPRSRGRISEASCCPQGRNLQSCGEPECPVNLQQRKAMSVWGDPWNPCHPGPSSTFQAAPATGEATLKLDLQLGDTDELGKLQRHPLGGALEADRETEAQAHCRHRALLCLSHSHSSWNGGEEGNSAHVPFLVEKMFFSKLPSVAIQH

SEQ ID NO: 287 - protein, 116 aa, Homo sapien [sequence omitted]

SEQ ID NO: 288 - protein, 166 aa, Homo sapien
PHGQKSQWHPQTSPSAGPLQQLVWGKSEASCCPQGRNLQSCGEPECPVNLQQRKAMSVWGDPWNPCHPGPSSTFQAAPATGEATLKLDLQLGDTDELGKLQRHPLGGALEADRETEAQAHCRHRALLCLSHSHSSWNGGEEGNSAHVPFLVEKMFFSKLPSVAIQH

SEQ ID NO: 289 - protein, 207 aa, Homo sapien [sequence omitted]

SEQ ID NO: 290 - protein, 352 aa, Homo sapien
MAVWSPLVMPGRREGCCHTPVTNEETEAREAKGQKLRPCHTLGVHVCLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 291 - protein, 261 aa, Homo sapien
MAVWSPLVMPGRREGCCHTPVTNEETEAREAKGQKLRPCHTLGVHVCLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGGF

SEQ ID NO: 292 - protein, 269 aa, Homo sapien
MAVWSPLVMPGRREGCCHTPVTNEETEAREAKGQKLRPCHTLGVHVCLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGEDRQDLPDGS

SEQ ID NO: 293 - protein, 133 aa, Homo sapien [sequence omitted]

SEQ ID NO: 294 - protein, 163 aa, Homo sapien
WVHSTYRVDAEAQHKEGCRIGYGRIWAETWASRSLLYRPVHSSVLLSVLESAIEMTTLCSDALCSPQPGLTAPHEAQATAFPLLGRGEMRLLQGSPELAICRSLALLPTSLPCLASVSPLGDVSLQVPSPASDDAAAPGAAGGGQVTGQHLPLPKSPAVAGVH

SEQ ID NO: 295 - protein, 491 aa, Homo sapien
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGEECPGGKLCGQQSWFTLLSLCISAPGVKSFPSDLSPGAPVGLLRGSSLKTLHLPYHKFKCCMAFDTLDSQDTFQ

SEQ ID NO: 296 - DNA, 20 bp, Artificial sequence
  Synthetic
tcctcaagggccctccccag

SEQ ID NO: 297 - DNA, 25 bp, Artificial sequence
  Synthetic
ccacagccatctcctccatattctg

SEQ ID NO: 298 - DNA, 27 bp, Artificial sequence
  Synthetic
aagtgttcctctggatgacctacctgg

SEQ ID NO: 299 - DNA, 20 bp, Artificial sequence
  Synthetic
ctgaagccgagctcaaaggt

SEQ ID NO: 300 - DNA, 20 bp, Artificial sequence
  Synthetic
ccctgctcccacttgagatc

SEQ ID NO: 301 - DNA, 24 bp, Artificial sequence
  Synthetic
tgtgaaaaggaggctgggtgccag

SEQ ID NO: 302 - DNA, 22 bp, Artificial sequence
  Synthetic
agtgagagggtgggcatgtatg

SEQ ID NO: 303 - DNA, 21 bp, Artificial sequence
  Synthetic
tactccaggcgctctgaggat

SEQ ID NO: 304 - DNA, 26 bp, Artificial sequence
  Synthetic
ttagccagtggcctccactctgtccc

SEQ ID NO: 305 - DNA, 21 bp, Artificial sequence
  Synthetic
tccagatggctcagcttcttc

SEQ ID NO: 306 - DNA, 23 bp, Artificial sequence
  Synthetic
gaaggtgttcggagaatgagtga

SEQ ID NO: 307 - DNA, 29 bp, Artificial sequence
  Synthetic
tttcttctgtggctctgtgttttccaggc

SEQ ID NO: 308 - DNA, 18 bp, Artificial sequence
  Synthetic
cctgccgcggagatccat

SEQ ID NO: 309 - DNA, 19 bp, Artificial sequence
  Synthetic
gcagcgcgtactggtcgta

SEQ ID NO: 310 - DNA, 23 bp, Artificial sequence
  Synthetic
cctactccgtgtcagtggtggag

SEQ ID NO: 311 - DNA, 19 bp, Artificial sequence
  Synthetic
agaggcgcccccgcaggta

SEQ ID NO: 312 - DNA, 19 bp, Artificial sequence
  Synthetic
cccggagccagctcgagtt

SEQ ID NO: 313 - DNA, 22 bp, Artificial sequence
  Synthetic
caggaactgcggcgagcgaccc

SEQ ID NO: 314 - DNA, 22 bp, Artificial sequence
  Synthetic
tgcccagctgtggtttacatta

SEQ ID NO: 315 - DNA, 19 bp, Artificial sequence
  Synthetic
caccacctcgccattctca

SEQ ID NO: 316 - DNA, 24 bp, Artificial sequence
  Synthetic
ttcactgtgaacatcatcttggca

SEQ ID NO: 317 - DNA, 25 bp, Artificial sequence
  Synthetic
gctcaaagcgtgagtaaaatatcct

SEQ ID NO: 318 - DNA, 28 bp, Artificial sequence
  Synthetic
ccacacttactttgtaacatgattcaga

SEQ ID NO: 319 - DNA, 40 bp, Artificial sequence
  Synthetic
tttgacttaatacttctttaattgatgtgccttgagttgg

SEQ ID NO: 320 - DNA, 19 bp, Artificial sequence
  Synthetic
ggcggtgactcatcaacga

SEQ ID NO: 321 - DNA, 26 bp, Artificial sequence
  Synthetic
cattgacgattattattcacaaagca

SEQ ID NO: 322 - DNA, 28 bp, Artificial sequence
  Synthetic
gcggccagagaatgtgtctgtgaaaact

SEQ ID NO: 323 - DNA, 27 bp, Artificial sequence
  Synthetic
cctttttatccacttacagatcaacca

SEQ ID NO: 324 - DNA, 23 bp, Artificial sequence
  Synthetic
acaagcaagatgcatgtgagtga

SEQ ID NO: 325 - DNA, 19 bp, Artificial sequence
  Synthetic
atggttcgctgctgccgtt

SEQ ID NO: 326 - DNA, 20 bp, Artificial sequence
  Synthetic
cctcacttcgcagctttgct

SEQ ID NO: 327 - DNA, 25 bp, Artificial sequence
  Synthetic
ctggcattgacgattattattcaca

SEQ ID NO: 328 - DNA, 32 bp, Artificial sequence
  Synthetic
ctgtgaaaactacaagctggccgtaaactgct

SEQ ID NO: 329 - DNA, 23 bp, Artificial sequence
  Synthetic
ggagccctgagcattgtaatatg

SEQ ID NO: 330 - DNA, 19 bp, Artificial sequence
  Synthetic
ccctggtagccgggtagag

SEQ ID NO: 331 - DNA, 22 bp, Artificial sequence
  Synthetic
cagatggtgtgccaactgctgt

SEQ ID NO: 332 - DNA, 20 bp, Artificial sequence
  Synthetic
cgcctgacccgactgtctta

SEQ ID NO: 333 - DNA, 23 bp, Artificial sequence
  Synthetic
gctcagattctggctccaagtct

SEQ ID NO: 334 - DNA, 21 bp, Artificial sequence
  Synthetic
cctacagcaaagcgcccccca

SEQ ID NO: 335 - DNA, 18 bp, Artificial sequence
  Synthetic
cctgcagcccagagcaat

SEQ ID NO: 336 - DNA, 22 bp, Artificial sequence
  Synthetic
gctcagattctggctccaagtc

SEQ ID NO: 337 - DNA, 21 bp, Artificial sequence
  Synthetic
atctccaaccctcccgcttct

SEQ ID NO: 338 - DNA, 24 bp, Artificial sequence
  Synthetic
tcattggctttggtatttcagaag

SEQ ID NO: 339 - DNA, 23 bp, Artificial sequence
  Synthetic
gttcaggaagcaaagatcaatgc

SEQ ID NO: 340 - DNA, 26 bp, Artificial sequence
  Synthetic
agcaatgaagggtttggttgtagaag

We claim:

1. A method for determining the presence of an ovarian specific protein comprising a polypeptide comprising an amino acid sequence with at least 95% sequence identity to SEQ ID NO:254 in a sample, comprising the steps of:
  (a) contacting the sample with a suitable reagent which selectively interacts with the ovarian specific protein under conditions in which the reagent will selectively interact with the ovarian specific protein; and
  (b) detecting the interaction of the reagent with an ovarian specific protein in the sample, wherein the detection of binding indicates the presence of an ovarian specific protein in the sample.

2. The method of claim 1 wherein the suitable reagent which selectively interacts with the ovarian specific protein is an antibody or fragment thereof that specifically binds to a polypeptide comprising an amino acid sequence with at least 95% sequence identity to SEQ ID NO:254 or a peptide thereof.

3. The method of claim 2 wherein the antibody or fragment thereof binds a peptide of SEQ ID NO: 254, wherein said peptide comprises amino acids 1-341, 191-198, 251-261, 4-23, 217-227, 321-331, 298-304, 341-366, 208-215, 267-275, 180-185, 285-294, 92-115, 121-146, 71-77, 212-214, 203-206, 154-157, 247-249, 365-367, 94-96, 151-156, 304-306, 48-51, 10-15, 188-193, 237-239, 150-153, 179-184, 227-233, 70-72, 66-68, 274-277, 203-205, 39-44, 81-84, 128-133, 276-278, 162-167, 187-190, 199-204, 210-213, 339-344, 279-282, 142-211, 172-215, 171-199 or 26-101 of SEQ ID NO: 254.

4. The method of claim 3 wherein the antibody or fragment thereof binds the peptide comprising amino acids 1-341 of SEQ ID NO: 254.

5. The method of claim 3 wherein the antibody or fragment thereof binds the peptide comprising amino acids 26-101 of SEQ ID NO: 254.

6. The method of claim 2 wherein the antibody or fragment thereof binds a peptide of SEQ ID NO: 254, wherein said peptide comprises a post translational modification, motif, or domain which is a thyroglobulin domain, TY domain, myristyl site, glycosylation site, pkc phospho site, ck2 phospho site, tyr phospho site or amidation site.

7. The method of claim 2 wherein the antibody or fragment is a monoclonal, polyclonal, human, humanized or chimeric antibody or fragment thereof.

8. The method of claim 2 wherein the antibody or fragment thereof is labeled.

9. A method for diagnosing or monitoring the presence and metastases of ovarian cancer in a patient, comprising the steps of:
(a) determining an amount of:
a polypeptide comprising an amino acid sequence with at least 95% sequence identity to SEQ ID NO:254;
and
(b) comparing the amount of the determined polypeptide in the sample of the patient to the amount of the ovarian specific marker in a normal control; wherein a difference in the amount of the polypeptide in the sample compared to the amount of the polypeptide in the normal control is associated with the presence of ovarian cancer.

10. The method of claim 9 wherein the amount of a polypeptide comprising an amino acid sequence with at least 95% sequence identity to SEQ ID NO:254 is determined with an antibody or fragment thereof that specifically binds to a polypeptide comprising an amino acid sequence with at least 95% sequence identity to SEQ ID NO:254 or a peptide thereof.

11. The method of claim 10 wherein the antibody or fragment thereof binds a peptide of SEQ ID NO: 254, wherein said peptide comprises amino acids 1-341, 191-198, 251-261, 4-23, 217-227, 321-331, 298-304, 341-366, 208-215, 267-275, 180-185, 285-294, 92-115, 121-146, 71-77, 212-214, 203-206, 154-157, 247-249, 365-367, 94-96, 151-156, 304-306, 48-51, 10-15, 188-193, 237-239, 150-153, 179-184, 227-233, 70-72, 66-68, 274-277, 203-205, 39-44, 81-84, 128-133, 276-278, 162-167, 187-190, 199-204, 210-213, 339-344, 279-282, 142-211, 172-215, 171-199 or 26-101 of SEQ ID NO: 254.

12. The method of claim 11 wherein the antibody or fragment thereof binds the peptide comprising amino acids 1-341 of SEQ ID NO: 254.

13. The method of claim 11 wherein the antibody or fragment thereof binds the peptide comprising amino acids 26-101 of SEQ ID NO: 254.

14. The method of claim 10 wherein the antibody or fragment thereof binds a peptide of SEQ ID NO: 254, wherein said peptide comprises a post translational modification, motif, or domain which is a thyroglobulin domain, TY domain, myristyl site, glycosylation site, pkc phospho site, ck2 phospho site, tyr phospho site or amidation site.

15. The method of claim 10 wherein the antibody or fragment thereof is a monoclonal, polyclonal, human, humanized or chimeric antibody or fragment thereof.

16. The method of claim 10 wherein the antibody or fragment thereof is labeled.

* * * * *